United States Patent 7,745,391 (HUMAN THROMBOSPONDIN POLYPEPTIDE) - sequence listing, part 111

SEQ ID NO: 326241 - DNA, 5664 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326242 - DNA, 5101 bp, Homo sapiens
agagagaggagtgtgcagagcagagttatttagcattcaagggtggatctgcagaaaatcacacagcctcactgcgaagcatctgggcctggtggcaccgatggatgaggacagaaaatggggatcttttcagtgttttccttctaaaggttaggcatccggggctagaaagagtgagaaagacaaggattgatagaaaaggcagttccacgagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326243 - DNA, 5849 bp, Homo sapiens
  misc_feature (5823)..(5823): n is a, c, g, or t
  misc_feature (5849)..(5849): n is a, c, g, or t
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccnaaaggtggcctttaaaaaagctgctn

SEQ ID NO: 326244 - DNA, 5846 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtaagaattgcatgaacacatatttgctgccagaaataattattacattgccttcttcatattgaaaactaacagttcttaaaagggaagcagaggtgttaaagagcttggttacaatttattgctaagagtttggactttacattaggaagatagcctctgaaatacaacgaaaatcacatgacatgcccattccttctgtttgttactgggtaaaaatttttaccaacttttagttgattgactaactttttttttttctgaatgtatctctattgctttgtgttttttaacttgagattaaagttatatttctgatata

SEQ ID NO: 326245 - DNA, 1345 bp, Homo sapiens
  misc_feature (15)..(15): n is a, c, g, or t
cgcgcggtgactctngaggatcccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326246 - DNA, 983 bp, Homo sapiens
cggacgcgtgggtcgacccacgcgtccgggaaagacccgagttcatgatgaggtagccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326247 - DNA, 1571 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagaagaagaaacgctagagagtcggatggctgaggaagagaaacctgctgctcttcctgagaaagagtgtggggctgctaagtcctcagaccaacccaagggcctcagtaagggccaaatggagtctagtgcggaggcccaaatagttcccgaagagagtgccccagcaggggccccacatgagaaaagtgtaaaagaggtcaaggaggtgtctccagaagtaaaaaccccttcctctgctggggaaggtgtgtctttctcaggatttgcatgtgttttgttgcaaatgatctctccagtggcttaccaacctgatgcctttccaacgctatttcgctatttcatcgctgggtcttatgataacaagtccactgttgtaggcttaatgtgcagagagtgtggcttgcgcaagtgctgtgtggcagctggttttccagtgctgcagctgattcctggttttcctttgccatgatacaatacgctttgcagccaggctgatgatgctatgtgagcttctttttttattttatttttttacccgccccccctcatctcaaatgtttgccagtcacattgctaatacatgtatatttttgtttttattttggggacagcaattcatatgcttttatttcaaatcgtacagttggattttggcacatagaggc

SEQ ID NO: 326248 - DNA, 601 bp, Homo sapiens
gatgatctgtcactccatatatgaaacgggaggcttttaaagcttactagtcataaacaacttacctcccgactcatttcatcagtgaagctttcaatgttgaacattcataaatgaatatattgcccacatgtgcaccacttccagcctaaatcttctttggataagtaacctgttaccatgaatataaagaagagtttcatttaaatttaatttggtcccttagaaataagagactaaatgttccaacttttagaaaggattcaaataagatattttcattttgctaatttttagagttcttgttataccaaaaagaaaagcccctctgatttcttaggttagacatgggtaaaggagaaaggtattaatacgtgaagcaatccatataatagtataagaagggtgttatggtcttgcatcatatgaggaaatgatatgggctagaaattctaaaagactctttttacatatatggttggagggatggtaaagttaataaatttgtggtttgccgtagtctatctactgcagtcatttttgggaaatagttaccacgaatgcaagatatagttaaatcaaggtatttcttccctcatag

SEQ ID NO: 326249 - DNA, 368 bp, Homo sapiens
aaagagtgagaaagacaaggattgatagaaaaggcagttccacgaggtttgtattgtcacgtttgctttgtcctatgtggtctctctactaggtgaagctggttgtggggattagcttcaatcataatatttggcttggcttgttgatgaataggatttgaacctaatttagggctagcttatatggatattataataaagaattgtgtcttttattcttgatacaatatgaggttgtatatagcaggtattgccagccacagcgtttgatattttacaaattagaggaaaaaaaccaacatcagataaagttttgtttcattgtacagctataaggtagtttgtcccataaaaatctgtctttgctc

SEQ ID NO: 326250 - DNA, 724 bp, Homo sapiens
agcggaggatcccaggtgattttggtgtcaacacatgttggaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctaattctaccttgtcaaagattcctgctttacagggtagcacaaagtccccaagatac

SEQ ID NO: 326251 - DNA, 9639 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326252 - DNA, 9453 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagccatcagatgtcctatcagtaggatactcctaccttcaactatgtagcctagaatagaagtaaaaaatcagactaagatagtatagcat

SEQ ID NO: 326253 - DNA, 9693 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326254 - DNA, 7811 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtataggttgatgttcaaatacgccactttcattcacttaaaagtttttttaaaggct

SEQ ID NO: 326255 - DNA, 9645 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326256 - DNA, 5171 bp, Homo sapiens
agagagaggagtgtgcagagcagagttatttagcattcaagggtggatctgcagaaaatcacacagcctcactgcgaagcatctgggcctggtggcaccgatggatgaggacagaaaatggggatcttttcagtgttttccttctaaaggttaggcatccggggctagaaagagtgagaaagacaaggattgatagaaaaggcagttccacgagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326257 - DNA, 5925 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326258 - DNA, 5677 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggatttcctatgacattttctaccatttcctcatgtttactccaaaataaggatgtttcaccgagtttcaattctggctactattgcctaaatgttgcaaaggggaggtattcgtgttgataataaaagacacatggttctgatgaataaaatt

SEQ ID NO: 326259 - DNA, 1447 bp, Homo sapiens
gtgtatggatcacctgaggtcaggagttcgagaccagcctggccaacatggttaaaccccgtctctactaaaaatacaaaaattagctgggtatggtgatgggcacctgtaatcccagctactcgggagcctgagggtggagaatcgcttgaacccagaagacggaggttgcagtgagctcagatcatgccactgcactccagcctgggcgacagagcgagactttgtttcaaacaaacaaacaaaactatgttcacaatttatttgttttgtaatccttattcttttctgctttcactaaagactcagcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaatttaaaaaaataaaaaaggaagtaaaaattttaca

SEQ ID NO: 326260 - DNA, 958 bp, Homo sapiens
tatatttatttatttatttatttttttgagacaagagtcttgctctgtcgcccaggctagattgcagtggtgtgatctcggctcactgcaagctccgcctcctaggttcacacgattctcctgcctcagactcccgagtagctgggactacaggcatatgccacaacacctggctaattttttgtatttttagtagagatggggtttcactgtgttagccaggatggtctcaatctcctgacctcgtgatccacctgcctcggcctcccaaagtgctgggattacaggtgtgagccaccgcgcctggcctttcctatgtttttaatacttttctataattttttaatggctgcatactggtgcactgtctagctgctctatagttatttgattgtttccagggatagttattgaaagcatgtggccagtaaggggtttatcgttggaatctgttggttacatataattatatatacttgcatagggccttataatcttttttcctcctgaatatgtgcaccattaaagttttagtatgtgctttttaaaaagttgtattatcaaaatgacattttcttaatatctttcagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaatta

SEQ ID NO: 326261 - DNA, 710 bp, Homo sapiens
cggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaaggtgaggtcttgtatggatgggaagggtgaggtgcgtcggccagaggcttatttattgacgggactgtttcctttggcccacgcgacgtagtcttctgttgtccttgactgggcgccgcctcccgccccgccgcctcggaagcccctgagagccggcagatggggggcttttagccacggtctctggtctgatgaagcagaaaagaagatgaggatcagggggtcctcgggaacgctgtcacgaatgtaggcttgcaggtgaccttccctctgcagggaaaattcaggacatttccctctcagaggaggaggccgttttattccccgggagaggaccagtgtccgatgacttaggccttaagactaagcctttccccccagatttttacacgcctgatacagtgcatgattgtttggtcgctgttgtgttagcaatggctcacgcttctgtttgttgtccttgtttgtttggtccattgaccacgttggacagcatttttttattcctttaactaacgggaaattgagaaa

SEQ ID NO: 326262 - DNA, 3084 bp, Homo sapiens
cggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaaaaaaaaaaaaaaaaaactcgactgaggcgggtggatcacgaggtcaggagatcaagaccatcctggctaacatggtgaaaccccatctctactaaaaatacaaaaaaaattagccaggcgtgatagtgggcacctgtaatcccagctactggggaggctgaggcaggagaatggtgtgaacctgggaggcggagcttgcgccactgcactccagcctgggctacacaagcagactctgtctt

SEQ ID NO: 326263 - DNA, 2551 bp, Homo sapiens
  misc_feature (40)..(40): n is a, c, g, or t
  misc_feature (42)..(42): n is a, c, g, or t
  misc_feature (44)..(45): n is a, c, g, or t
cgtgacgcgtgggcggacgcgtgggtcgacccacgcgtcngngnncagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaatta

SEQ ID NO: 326264 - DNA, 2558 bp, Homo sapiens
ctatcaaaagtagacaaccataagtttgcatccagagcaatacagaggaataataaggaatgaaaaattttaggtttgtagttagagtcaattcatccattatcatctgctataataaactgttaatctgtttttcgcttcaatatctttgatggtcagttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaatta

SEQ ID NO: 326265 - DNA, 3747 bp, Homo sapiens
gactacaaacgggatgcacagggggacatttagggtgcaggatctgcgctgtacattagggtggtgaatacatgacccgttgcatttgtctgaacccacagaatggcacagtacaaagagtgaacttcaacaaatgttaaccaaacaacaaccactaacatcaaccaaaacgtcagaggatcccaagatgaaatgtggattgcgacaaatgaaactaactgcattacaaatgtatgacataacttcactgaaggggcggtgaaaaaggagcttacctaacaaactttggaacacggtgttttgacttgaaattgtaaggctaatgacaaaagaaactgtacataaatactgtactcatggggtatggggtaataattctaaatttgcttttcatgtgtacataggttgaaaaaataagtggatggataatggggtggctggagccaggtttcttatggtcagacaaggaagtcacagattaaaaaggaggactagagtgaaccttgtggtaatggattataatcagagacatcaatatcaactcatgtttaacttaacatatatgccaactgatacatatagaaacaattagagatgtatgtgtatacatgggttagtattcacacagatattacctagctctgtcccctgagagggcctaaaagcaacgatactccaatagcaatgagcacacctagtaactacattttggttcctaaataaaaggaatgctagttccttcaaatggctgattctacagctgatgcaaagaaaatacaagatgagcctggagcatcttctagtaccacgtcaggagatgttcaaaaaacaaaaggataggggcatatgaaagggacataaacagtaaccggaaaaccttcccaatagccaaagttggaacaatttaagcaaaagaaaagaaacctagcattagaactcaaagtataaaataaacatacatgagtccatactgatataaatgactgaataaacagataaatgtggggaaagatccaaatcttccttacagaagaatttcaaaccatgtatgtagatatctcccccttcctaaagtgtgggttggacttagtaatgtgttcccaaaaaacagagtatagtgaagaaacctagcaaacactatcttaaccaagtggtcatggttaacatcaccagtgatgccacgtggacatcatgcacccctgatgagaggaaaagaggattctttccaaaaacgcataacccagtctaataccgagcaacagcagcaaacgcagactggggggcattctacaaagtcctcggggatggcaaggtcgtgacaaacaaggaaaaactgagaaactgtcacaaaccaagagactggggaaacatgaaaactacaggcaatgtggtatcctaaatttgatcctagaacagaaagaggccattaatgaaaaagctggaaaaatccaaatgaagtatgaagtttagttaacagtatgtactaaggttggtttcttagttttcacagatataccacaataatgtaagatgtcagcaatcaggaaaactaggtgtagggtatatgggaactctacgtgaattttctgtgttatttatgcaacttttctctaaataaaaaattaatccaaaaaaagtttaaggattagtctatggtactagaagtcagaatagtgggtactctcaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaatttaaaaaaataaaaaaggaagtaaaaattttaca

SEQ ID NO: 326266 - DNA, 1577 bp, Homo sapiens
tcatttagaggtactatggtttaaaacacagccttaaaattgtaggtatttaacattgtgatctggtgatcattgctttccctgcctcctcctccctatctgtggcatggtaagtagatggaagatagtaggcatgatacttaagcatagtttttcctattctttaattaacatctgaatctctggagagaagttccccaatttttctgggacctgcccatagttattctgaccacaggataatttgctaggctttttattctgaataattacttttagaaaacgtgtcttagctgatactcaggcatatttcacagtagcattggcaagatgctttggattaaactaaatctggttgtatatgtgtgtctgtatgttgggctaacaaattgaagacattcatgttacacctaagacttgggacaacctatattatagaggcaaatatggtttggtgttcagcttacttgtaatattttaaaatcaaagttgtttttttttttaaataggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaatta

SEQ ID NO: 326267 - DNA, 1457 bp, Homo sapiens
  misc_feature (1390)..(1390): n is a, c, g, or t
  misc_feature (1417)..(1419): n is a, c, g, or t
  misc_feature (1457)..(1457): n is a, c, g, or t
cggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttcgaattctagcattaaacagtggtgcctcaaaacgtgggtttgtaccaaccagaagaanaacatctgcctcttccacaccagcaannntagtattaagaagataattggaacgtcgacgcggccgn

SEQ ID NO: 326268 - DNA, 1859 bp, Homo sapiens
cggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagcactcttgcgcttccaagcttatcgttcatctaatacatacaacttgcatggctgctgcgcacagaggccagatgcttggcttcgtatatggctcggtacaacaccctacgctactcagaggcaccacctgattctacactgcttacgaattcgacaacgagctggactgcactacactgcaccttacacacgtggcccttactagggcagatccagctggaccctcaccttatcacactatgacaccaacctgcggcacacctcccccgaagacattcttcaagcacatctgcgtcccgtgcgaagcccatccgaattaagccaacgtcctcaacagggacgcttacacaacaccacacggcagggaccaagagccagttcatggcacatcccagaacgaccaaacggactggacgccagccaacatacctcggcacactggacgcacacgccattgcacaaacaagatcacgcactgacctacgcgagcgaaacctggctcgcccggacacagtaatgaatactaccaacacagg

SEQ ID NO: 326269 - DNA, 1788 bp, Homo sapiens
tatatttatttatttatttatttttttgagacaagagtcttgctctgtcgcccaggctagattgcagtggtgtgatctcggctcactgcaagctccgcctcctaggttcacacgattctcctgcctcagactcccgagtagctgggactacaggcatatgccacaacacctggctaattttttgtatttttagtagagatggggtttcactgtgttagccaggatggtctcaatctcctgacctcgtgatccacctgcctcggcctcccaaagtgctgggattacaggtgtgagccaccgcgcctggcctttcctatgtttttaatacttttctataattttttaatggctgcatactggtgcactgtctagctgctctatagttatttgattgtttccagggatagttattgaaagcatgtggccagtaaggggtttatcgttggaatctgttggttacatataattatatatacttgcatagggccttataatcttttttcctcctgaatatgtgcaccattaaagttttagtatgtgctttttaaaaagttgtattatcaaaatgacattttcttaatatctttcagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaatttaaaaaaataaaaaaggaagtaaaaattttaca

SEQ ID NO: 326270 - DNA, 982 bp, Homo sapiens
  misc_feature (40)..(40): n is a, c, g, or t
  misc_feature (42)..(42): n is a, c, g, or t
  misc_feature (44)..(45): n is a, c, g, or t
cgtgacgcgtgggcggacgcgtgggtcgacccacgcgtcngngnncaggcctccgcggctccggggagaagcaatatgttaaggatacctgtaagaaaggccttagtaggcctttctaagtctcctaaaggatgtggtgagtattttcttaaatttgcattcgtggatattagaccttatttttgtaaatttataagtctatggcatagtttatcaaagaccctaaacccatgattttttaaaataaaaatagaaaccggccgggtgtggtggctcatgcctgtaatcctagcactttgagaggctgaggcaggtggattgcttgaagccaggaattcaaaaccagcctggccatcatagtgaaaccccatcactactaaaaatataaaaatcagctgggcatggtggggcacacctgtaatcccagctacacaggaggctgaggcacaagaatagcttaaacccgggaggtggaggttgcatacagccaagattgtgccactgcactccagcctgggagatagatcgagactccatcttggaaaaaaaaaaaaaaagaagaaacaaatgatctaagttgaataattttcaaaatataattttactttaaacagtttataggaattatcatggaatagaaagtattaggaactacacacatcaatgccaaaatggaaaaatcacattctgtttttgaaaagtgatcttcccatgaacatattttcagtgacattaagagtttcagtttaaagttgggtatggtggctcactcctgtaatctcagcactttgggaggccgaggcagaaggattacttgaggtcaggagtttgagaccatcctggccaatatggcgaaaccctgtctctactaaaaatacaaaaattagcgggcgtggtggtgagttcctgtaatcccagctactcggaaggctgaggcaggagaatcgcttgaaccggggaggtggaggttgtagtgagccaa

SEQ ID NO: 326271 - DNA, 2644 bp, Homo sapiens
cggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaatta

SEQ ID NO: 326272 - DNA, 962 bp, Homo sapiens
  misc_feature (40)..(40): n is a, c, g, or t
  misc_feature (42)..(42): n is a, c, g, or t
  misc_feature (44)..(45): n is a, c, g, or t
cgtgacgcgtgggcggacgcgtgggtcgacccacgcgtcngngnncaggcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagaatgcggagtcatgattggggaaccacagccgagaactgaactgcacgtgggccctcttgacgagggtccccgtctgaccgccgggaattcatgacatcgccgtagggcccaacctcagcctagcttaaaggccggctggaacaagagccacaccctgtgataggtggggccgcactactgggctcccacggcagtaggagatttctcgtcgcgtggccccacggctctacaccccttcggggaacccgccgcagaggacaccagggctcccagagaaacagcaggtcgccaagtaagaccgaatagtaacagaacacatgcg

SEQ ID NO: 326273 - DNA, 3474 bp, Homo sapiens
cggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaatttaaaaaaataaaaaaggaagtaaaaattttaca

SEQ ID NO: 326274 - DNA, 2851 bp, Homo sapiens
cggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattaaaaaaaaaaaaaaaaaaaaaaaaaaaaaaaaaaaaaaaccgggggcatttatattgtggggggggggaaaaaggggttatgaaaggggccggggataggggtgtttttgggaccagttttttgtgtttaaagggtggaaaattcgggggggccccaatatagggaggggaatataatttgaaaaagcgggtgtacgggtttaaagag

SEQ ID NO: 326275 - DNA, 1965 bp, Homo sapiens
cggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaagacatcatggtgatgttgaggctccccatagatagtatttctgggatcctactagagtcatcactgcaggtaat

SEQ ID NO: 326276 - DNA, 4714 bp, Homo sapiens
  misc_feature (2)..(4): n is a, c, g, or t
  misc_feature (6)..(6): n is a, c, g, or t
  misc_feature (8)..(9): n is a, c, g, or t
gnnnangnntgcggccgcccgaagaggagagagcgcgggcctctaggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaag

SEQ ID NO: 326277 - DNA, 1208 bp, Homo sapiens
  misc_feature (2)..(4): n is a, c, g, or t
  misc_feature (6)..(6): n is a, c, g, or t
  misc_feature (8)..(9): n is a, c, g, or t
gnnnangnntgcggccgcccgaagaggagagagcgcgggcctctaggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacaggtatggcctcacaagtcttgggctacccaccatatgtttatcaaactcagtcaagtgcc

SEQ ID NO: 326278 - DNA, 4872 bp, Homo sapiens
cggccgcgcggcggggctgttgccggcttctctcgttacggtggctgccgcccgcttcccttcgccgcactgggagaactggcggaaagactttggatgaaaatgtctgtttctctgtcgggagggagacggctgttgtaaaatggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacagaggtattttggtaaaactaatggaatgggagccaggaagagaggaaataaatgctttcagttggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaag

SEQ ID NO: 326279 - DNA, 3662 bp, Homo sapiens
  misc_feature (2)..(4): n is a, c, g, or t
  misc_feature (6)..(6): n is a, c, g, or t
  misc_feature (8)..(9): n is a, c, g, or t
gnnnangnntgcggccgcccgaagaggagagagcgcgggcctctaggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagctattagggaggctgaggcagaagaactgcttgaaccaagggagcaccccaatttctgccatcgggtgattgacttcactgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtg

SEQ ID NO: 326280 - DNA, 3329 bp, Homo sapiens
  misc_feature (1)..(1): n is a, c, g, or t
ngcttgaatttgcaactgaatgggatgtattcaaaacatctacagagaaatgagcaaattcttgaatttgcaactgaatggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaag

SEQ ID NO: 326281 - DNA, 4318 bp, Homo sapiens
gcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgaagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcagtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcctagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtctttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326282 - DNA, 3864 bp, Homo sapiens
ttcatgatggcctcatgttactaatgaggaaactggggcccacagtcagacatgagccactggtgggacagaaataggctcctggttctgtgtgatccaaagttggtgcttttctgtctatccctagctgttggtcaccaccagctttctgcatattttctcacggtgcctctcatttcccagagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcagtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcctagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtctttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326283 - DNA, 4198 bp, Homo sapiens
  misc_feature (3657)..(3657): n is a, c, g, or t
ttcatgatggcctcatgttactaatgaggaaactggggcccacagtcagacatgagccactggtgggacagaaataggctcctggttctgtgtgatccaaagttggtgcttttctgtctatccctagctgttggtcaccaccagctttctgcatattttctcacggtgcctctcatttcccagagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcagtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcctagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttctgctttttctcggggtctgtgacaccgtaaaagtagccatcttgganccgggaggggggggggagggggaggggaggaagggagggaaagggggagagggggagggggggggggggggggggaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtctttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326284 - DNA, 1563 bp, Homo sapiens
tgacgaaaaatcagaataggtgtggtatagaatggggtctcctcctccggggggtcgaagaaggtggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcctagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtctttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326285 - DNA, 1670 bp, Homo sapiens
gcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgaagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcagtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326286 - DNA, 4097 bp, Homo sapiens
ttcatgatggcctcatgttactaatgaggaaactggggcccacagtcagacatgagccactggtgggacagaaataggctcctggttctgtgtgatccaaagttggtgcttttctgtctatccctagctgttggtcaccaccagctttctgcatattttctcacggtgcctctcatttcccagagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcagtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcctagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtctttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326287 - DNA, 4814 bp, Homo sapiens
ttcatgatggcctcatgttactaatgaggaaactggggcccacagtcagacatgagccactggtgggacagaaataggctcctggttctgtgtgatccaaagttggtgcttttctgtctatccctagctgttggtcaccaccagctttctgcatattttctcacggtgcctctcatttcccagagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcagtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcctagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtctttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataatagccttctgcctgctcctggcttgcttggtttctggggtcccttttgggatggagagaatgggagtggcccagcccttacagactccaagaaacgattggtcctccttacagtgacagcctcggatggacataactgtcctggtgccccttcttgaccacctatccatcccatcaacacaggatacatcattgtgcttgctaccgcagatgcttttctacactggaaacaggttccacaaagttagaaaccgctccagttcccttagccagttggtggtggcagcagagcctggagaacggggtacttcatggctctttaggaattgtctattcctggggggaggagagcggggacagcctccagcctactctagatctagtacttgatccttagtactagatccttagatgtgggcaaggatgagaacagcttgcctaagccaggttccatccaaaagcccggtgcttggattctcaacccttttcttgggctggacaatttcggagctgccttaagagtgagacagcccagcccagagaaagccacccttctgccagtggccgatttccttaggagctctgctatctcccagtggcccgggccatattttccccttcccagggcctgtgcctatcaatgctgcccatctaggagagaaacctcccaccttggcctccctctcaaagtgctgggattatggacgtgagccaccattc

SEQ ID NO: 326288 - DNA, 3677 bp, Homo sapiens
ttcatgatggcctcatgttactaatgaggaaactggggcccacagtcagacatgagccactggtgggacagaaataggctcctggttctgtgtgatccaaagttggtgcttttctgtctatccctagctgttggtcaccaccagctttctgcatattttctcacggtgcctctcatttcccagagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcagtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcctagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326289 - DNA, 3382 bp, Homo sapiens
ttcatgatggcctcatgttactaatgaggaaactggggcccacagtcagacatgagccactggtgggacagaaataggctcctggttctgtgtgatccaaagttggtgcttttctgtctatccctagctgttggtcaccaccagctttctgcatattttctcacggtgcctctcatttcccagagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcagtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagaccccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326290 - DNA, 771 bp, Homo sapiens
gcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgaagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataata

SEQ ID NO: 326291 - DNA, 314 bp, Homo sapiens
ttcctgggtgatgctgatactgatgctgcaggtcctcaggcccctctgctgtgggaaccactgctcaagatcataggaacacctaagcatcttcccactacatgctactgctattcatttatcccctattattcacattaacaatatattatttggtatctgttaacaaatttaatcatccataacccaaataaatccctgaactcctcataccagtttcaggtggagaagtacattcaaaccccaagtccagcaatggattaaaaaaaaaaatcacctcttgtgtggccattcctcttgattgacaactctta

SEQ ID NO: 326292 - DNA, 216 bp, Homo sapiens
gcctacttgagggtggaaggtggaaaaacaaagagggtgtgggcattgtggctcacgcctgtatgccaccacattgggagaccaaggcagatgaatcacttgaggtcaggagttcgagaccagtctggccaacatggtgaaaccccatctcaactaaaaatacagaaattagcctggcatggtgatacacagctctaatcccagccactcaggagg

SEQ ID NO: 326293 - DNA, 550 bp, Homo sapiens
tttgagacggagtcttgctctgtcgcccaggctggagtgcagtggcgcgatctctgctcactggaagctccgcctcccgggttcatgccgttctccagctactcaggaggttgaagcaggagaattgttgaacccgggaggcggaggttgcaatgagccaagatagcaccactgcactgcagcctgggtgacagagcgagactccatctcaaaagaagggctcctgtgtctacgtcatggtggggctagagagaggtccccgcagctgggctgtgttgagtgagggctcgtctcttcagcgccaggcaatagtttgtcttgtctctgtcccttttctgtgtccacatgacatttacatcttgcgagttgcataatttaagttgtttatttacattatacatttaattgcattctatagcgatgctatgttgaatgtattctgatcggatcgtttatggttatttacaatgcagttactcttgaagattattgttagaggtagactgttgatttgttttgataaaataaagcttttgtgttttaaaaaatg

SEQ ID NO: 326294 - DNA, 1659 bp, Homo sapiens
ctgtggaccgggtgactgtacttctgtggaccgggtgactatgcttctgtggaccggtgactgtgcttctgcggaccgggtgactgtacttctgtggaccgggtgactatgcttctgtggaccgggtgactatacttctgcggactgggtgaatgtacttcagccgaccgggtgaccatgcttctgcggactaggtgactatacttctgcggactgggtgaatatacttctgctgactgggtgaatgtacttctgcagactgggtgactatacttccatggactgggtgaacatacttttgtggactggttgactatacctttgtggactcggtgaatatacttctgcggaccgggtgaccgtgcttctgtggaatgggtgaatatacttctgcggaccaggtgactatgcttctgtcaaccaggtgaatatacttctgtggaccgggtgactgtacttctgtggaccgggtgaatatacttctgtggaccgggtgaatatacttctgtggactgggtgactagggaggagccggcgtgttagcgccagcatatgcagtccctcaggacagccagcctgccgtgatcctgtctgtgtggtcgtggcagtggcctgcagcaagccatcgtggttggctggaactagacgtgtgatttgaatgcaggagttcagtcagcccctcagtggcctaaaaggaagaaggtgtcagtcacagggctggttctgggccctgccttggggggaccccagttccagggttctgggccctgccttcaggggacccgagttccagggtcctgggccctgcctttgggggacccgagttccaggtcccggcctcagcgttgcagtggccagggtcagtggctctttggccctctaggagtgagcagaccttagtgaaatagatccacagggtcctgactttgtacctggtccaagctgttggggaattgctgctgttgacccaggcaggagtctgactagagaacaaactaaggttgctgcaacaaacaaggacctcttccaagaagggctcccaggcctggcgcagtgactcatgcctgtgatcccagcacttgggaggccgaggcgggtggatcatttgaggccaggagttcgagaccagcttggccaacatgatgagacccccgtctctattaaaaatacaaaaattagccaggcgtggtggcgcctgtagtcccagctactcaggaggttgaagcaggagaattgttgaacccgggaggcggaggttgcaatgagccaagatagcaccactgcactgcagcctgggtgacagagcgagactccatctcaaaagaagggctcctgtgtctacgtcatggtggggctagagagaggtccccgcagctgggctgtgttgagtgagggctcgtctcttcagcgccaggcaatagtttgtcttgtctctgtcccttttctgtgtccacatgacatttacatcttgcgagttgcataatttaagttgtttatttacattatacatttaattgcattctatagcgatgctatgttgaatgtattctgatcggatcgtttatggttatttacaatgcagttactcttgaagattattgttagaggtagactgttgatttgttttgataaaataaagcttttgtgttttaaaaaatg

SEQ ID NO: 326295 - DNA, 642 bp, Homo sapiens
tcaccctggcctgccttcagctgatgggacgaagatgcgcgcagtcttctcccatcaggtaggtaccctcgcatacacacccaggattaatactttgcatttgttaatccaatcaagttgacactcagtattaaccatcacaagtccaccccttgtcaacttgaacccatacacatctcctgagatcatacataatcttcaaataaagacactaataaggtcataattatacctaacataatacaactatcttttgtacaactggaaacaaaccaatccccaacccaaatgctattacataaagttaacaatacttaaatgctgatgggacgaagacgcatcttctcccatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagcaagatgccatcttctcccatcagttttctttagttctcattacatctgtccaggctctttatcagcatcatcctttcctgatggacgcaagat

SEQ ID NO: 326296 - DNA, 508 bp, Homo sapiens
ctgcaggtcatgtaaaaatttaaaaaaaataaaatgagtttgggtgtgattattcatgtatgaaaagattctcttcttatcccttaatggttctctaaaatagtgatgtcatttctttttataaattgagacccgtgtctgcaaaaatgattaaatattgagatagcattggtaaatggagcagggcaagtggtgctggccagtagaattttgggtgacttttgttttttagagttgtttacaggatagattaatatgtttttcattcaaatcaatgtgcttttcattcttattttctatttagtgcatctaagtggcattctgattcacattattgataagactgatttcctagagttgttcttcactggatgacagcagtcgtatgtctagggaatgtgaatgaaccgctgcctggaggagtaagtcacacagtaaaagaaagtgtaggcatacctcggatatactgtgagtttagttccagactactgaaataaaacaagtacag

SEQ ID NO: 326297 - DNA, 3396 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
  misc_feature (3096)..(3096): n is a, c, g, or t
  misc_feature (3105)..(3105): n is a, c, g, or t
  misc_feature (3109)..(3109): n is a, c, g, or t
  misc_feature (3115)..(3115): n is a, c, g, or t
  misc_feature (3119)..(3119): n is a, c, g, or t
  misc_feature (3121)..(3121): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaaggttaaaacaaaaaanagagaaccnaagnagacanagangnacaacaagaaagacacaacagaagaaagaaggaaaacaataaaaacaaaacaaaaaagaaaacacaaccaaaaaaaataggaagacgacaacacaaaacaccgcgacagaatacgcacacacaggccgcagcccttcttgcgccgctaccgccgcacaactcatcccagcatgtccgctgagcgcggcaaccgacctaccggtggcgggaccgcggaatgcactggtatcgactatccacggaacccggcgccagtccccacagagtaacgcgcc

SEQ ID NO: 326298 - DNA, 3526 bp, Homo sapiens
  misc_feature (3226)..(3226): n is a, c, g, or t
  misc_feature (3235)..(3235): n is a, c, g, or t
  misc_feature (3239)..(3239): n is a, c, g, or t
  misc_feature (3245)..(3245): n is a, c, g, or t
  misc_feature (3249)..(3249): n is a, c, g, or t
  misc_feature (3251)..(3251): n is a, c, g, or t
cctgttactttcacttggagaatagggaggcttggggtgggggcaggactgtggaggaagtcaagtttgctgtcttctatggttgtggtttgtggcacaacaaaacaattatactagtaataccaaagatcactgatcatagatcatgatgacagatataagaataatgaaaaagtttgaaatattgtgtgagaattaccaaaatgtaacatagagacatgaagggagcacatgctgttagaagatggtactgatacacttactcaactcagggctgcttccaaccttcaatttgtaaaaaaaccagaaaacctcaggatccacaaagtatcatcaaatgaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaaggttaaaacaaaaaanagagaaccnaagnagacanagangnacaacaagaaagacacaacagaagaaagaaggaaaacaataaaaacaaaacaaaaaagaaaacacaaccaaaaaaaataggaagacgacaacacaaaacaccgcgacagaatacgcacacacaggccgcagcccttcttgcgccgctaccgccgcacaactcatcccagcatgtccgctgagcgcggcaaccgacctaccggtggcgggaccgcggaatgcactggtatcgactatccacggaacccggcgccagtccccacagagtaacgcgcc

SEQ ID NO: 326299 - DNA, 3562 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
  misc_feature (3262)..(3262): n is a, c, g, or t
  misc_feature (3271)..(3271): n is a, c, g, or t
  misc_feature (3275)..(3275): n is a, c, g, or t
  misc_feature (3281)..(3281): n is a, c, g, or t
  misc_feature (3285)..(3285): n is a, c, g, or t
  misc_feature (3287)..(3287): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccagatgcaggtctctctatgttacccaggctggtcttgaactcctgaggtcagggaggaatcccccacctcagccttgcaaaatgctgggattacagggctgcttccaaccttcaatttgtaaaaaaaccagaaaacctcaggatccacaaagtatcatcaaatgaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaaggttaaaacaaaaaanagagaaccnaagnagacanagangnacaacaagaaagacacaacagaagaaagaaggaaaacaataaaaacaaaacaaaaaagaaaacacaaccaaaaaaaataggaagacgacaacacaaaacaccgcgacagaatacgcacacacaggccgcagcccttcttgcgccgctaccgccgcacaactcatcccagcatgtccgctgagcgcggcaaccgacctaccggtggcgggaccgcggaatgcactggtatcgactatccacggaacccggcgccagtccccacagagtaacgcgcc

SEQ ID NO: 326300 - DNA, 3339 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
  misc_feature (3039)..(3039): n is a, c, g, or t
  misc_feature (3048)..(3048): n is a, c, g, or t
  misc_feature (3052)..(3052): n is a, c, g, or t
  misc_feature (3058)..(3058): n is a, c, g, or t
  misc_feature (3062)..(3062): n is a, c, g, or t
  misc_feature (3064)..(3064): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaaggttaaaacaaaaaanagagaaccnaagnagacanagangnacaacaagaaagacacaacagaagaaagaaggaaaacaataaaaacaaaacaaaaaagaaaacacaaccaaaaaaaataggaagacgacaacacaaaacaccgcgacagaatacgcacacacaggccgcagcccttcttgcgccgctaccgccgcacaactcatcccagcatgtccgctgagcgcggcaaccgacctaccggtggcgggaccgcggaatgcactggtatcgactatccacggaacccggcgccagtccccacagagtaacgcgcc

SEQ ID NO: 326301 - DNA, 874 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatccta

SEQ ID NO: 326302 - DNA, 768 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaataggcagcgatgtgctattgaaacttctaaaactatgcttttcttgacaaaccaatcctgattggcctaccgctttcaatagcaaattgagctgggaggagattcaaagatgctcattcaacaaatatttgttgagcacacattatatgccaagcactgtgataaggatacaatggtgagcaatacgggtacc

SEQ ID NO: 326303 - DNA, 845 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccagatgcaggtctctctatgttacccaggctggtcttgaactcctgaggtcagggaggaatcccccacctcagccttgcaaaatgctgggattacaggtgtgagccacgggggcccggcctgaataagtattcttattttaagaaaatctatttgtaaaatgagtttgggtgtgattattcatgtatgaaaagattctcttcttatcccttaatggttctctaaaatagtgatgtcatttctttttataaattgagacccgtgtctgcaaaaatgattaaatattgagatagcattggtaaatggagcagggcaagtggtgctggccagtagaattttgggtgacttttgttttttagagttgtttacaggatagattaatatgtttttcattcaaatcaatgtgcttttcattcttattttctatttagtgcatctaagtggcattctgattcacattattgataagactgatttcctagagttgttcttcactggatgacagcagtcgtatgtctagggaatgtgaatgaaccgctgcctggaggagtaagtcacacagtaaaagaaagtgtaggcatacctcggatatactgtgagtttagttccagactactgaaataaaacaagtacag

SEQ ID NO: 326304 - DNA, 355 bp, Homo sapiens
gccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaaggttaaaacaaatacgctatttccttttttttttttcattggtttgttctgagctctgagtttgaacaatgccgtttatttggggaggcaaccaaaagttccctgcatagaggaagagacatttagggtgcgtgtgagatac

SEQ ID NO: 326305 - DNA, 723 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcgtgtttggaaaaattattttccagcaaataattgggattggtttttctgggggacttgggagattattttgggctagtgggaataaaagttggagttaaggctttaaatgattgatgaaaaatatattcacatgggccaaatctttatttttgggtaacaaaattggcaggaacaggaggcaattatggaagaaatgaacctttgaagaaacttaatggttgcccaatagaaaggttaattgtaaggggg

SEQ ID NO: 326306 - DNA, 3245 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaaggttaaaacaaaaaaaaaaaaaaaacctgggggggggcccggccccaaatccgccttatagggagtcgtataacaatcatttggccggcgtttacaacggggggactggaaaacccctgggttaccaaacttaatcgctttggagaaaatcctctttccgccagt

SEQ ID NO: 326307 - DNA, 3466 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
  misc_feature (3166)..(3166): n is a, c, g, or t
  misc_feature (3175)..(3175): n is a, c, g, or t
  misc_feature (3179)..(3179): n is a, c, g, or t
  misc_feature (3185)..(3185): n is a, c, g, or t
  misc_feature (3189)..(3189): n is a, c, g, or t
  misc_feature (3191)..(3191): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccggctgcttccaaccttcaatttgtaaaaaaaccagaaaacctcaggatccacaaagtatcatcaaatgaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaaggttaaaacaaaaaanagagaaccnaagnagacanagangnacaacaagaaagacacaacagaagaaagaaggaaaacaataaaaacaaaacaaaaaagaaaacacaaccaaaaaaaataggaagacgacaacacaaaacaccgcgacagaatacgcacacacaggccgcagcccttcttgcgccgctaccgccgcacaactcatcccagcatgtccgctgagcgcggcaaccgacctaccggtggcgggaccgcggaatgcactggtatcgactatccacggaacccggcgccagtccccacagagtaacgcgcc

SEQ ID NO: 326308 - DNA, 3047 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
  misc_feature (2884)..(2884): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgaaggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtataacccatggcatttcgtttatntagcaaacataggctggatttacgacaaagttgttggtttggaaagggggttaaagccttaagctgaaccacaacaaccacacaccacacacacaaaaaaagggggcgccgcccaaaaaaaacccccgggggcccattcccacccctttttctacagggccca

SEQ ID NO: 326309 - DNA, 665 bp, Homo sapiens
  misc_feature (26)..(27): n is a, c, g, or t
  misc_feature (30)..(30): n is a, c, g, or t
  misc_feature (40)..(40): n is a, c, g, or t
  misc_feature (55)..(55): n is a, c, g, or t
tttttctctcccccagcccacggggnnccntttgtagacntcgttagaaacgccngccattgtgttggaaaccgggacttgggccattatgtcccggggaggggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgtatgttttgtcctttaatgtgtattttaatgtatattttgttcttttttggcctctatttttttttaaggaatatagctcagtagtgc

SEQ ID NO: 326310 - DNA, 1150 bp, Homo sapiens
aacaagacaaagtccctgcctccatggagctcacagtaataccttcttacactttcctaatttgctaatcttttcagactctctttataacacatttctgatataatttttcagtcctctccatgagtcgagtggtattatccccagtttgcagatgagaagactggtgcaggtagtttgcatcatttatccaaggtctctggtctcttagtcaaatgccgtttctataattccatattattctatggtggcatttaggatgctaaccttaaaaataagcagcatgctttttctgctagcttgtttttatatacgtttgagaccctagattttataaaaagtaatttcccagttttgctcgtggtgtactctttttttttttttttttttaagcattcagagcaacagaaaatgtaagagcatggtgaatgatccctacagccagagcttgaagcaaatgtaacttttttggcaggacagtcttatcttaaatgataacagcatcaaggaatgagggtttattttctatacaatccccttttctttataatccactatgggttcctttgtcacaactttgattttagagctacatgtgactgtgtctgtcatgtagctcagatgaggaaattgaagctcagaataaatgatttgcccaaaattacatggtgatctcagttcagttctagactgaactgagactagaactctacttcttttcatcctgcataatgtcatgggatctcctgtttgaatttactgctagggcttacctaggaccactgtcctaatacctctgaagataatggaatgagagtgaggttttaattagtttggctaattgttatggtattacctgcatgtagtataacctgaattttaaagtgttaagaaaaacccctttaaagctttgagtagtaatttttttctgattctttaataatttaataaactttgtaacttttgccatctgattaactccttggagcaaggggaggagcaaagtagccctccacagaaactgtcaggcccttttggtcctgatgtttttctcattccacattccttcattctcttgcctgtgccatttctctttgagcagtgtctctctccccagtgtggtgtctgtatgtttcatgcatttgtatcc

SEQ ID NO: 326311 - DNA, 357 bp, Homo sapiens
ctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcact

SEQ ID NO: 326312 - DNA, 2693 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgt

SEQ ID NO: 326313 - DNA, 2985 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaaaaaaaaaaaaaaaaaaaaaaaaaaaattgtgtttggggcggccttgggccccgggaaaagttttttaaaccttttggttgtggggggggggcgccccaggaagggtgataacagtgagaccacgtggcgccaaagcgcgtgggttccccaaaggagagagaccccggggccagagaaccacaggtgtggctggggtttcctcccccacaattaaaaaaagccgcccggggggaagaccggagggtgtctcggaaccaattcccaaaagggggagtcccaggagggccatcagcggggtcgctatcaccaggggggtcccaaggggggcccagaattaaaattaagg

SEQ ID NO: 326314 - DNA, 4144 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326315 - DNA, 4090 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326316 - DNA, 4101 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggtggagtcttgctctgtcgcccaggctggagtgcaatggcgcgatcttggctcactgcaacctcagcctcccaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326317 - DNA, 3972 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacagggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326318 - DNA, 1641 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggtggcagcaccatggatagctccgcaggaagcaaggctaggcgtgaggctggggaggacgaggagggattcctttccaaacttaagaaaatgtttacctcatgatatcccagccgaggatcttcgggctgtcgttagacaggttaatgaagaacacttctcaacagtttcctttttgttttcctttataattcactaaaataaagcatctattagtgtctgatttaggaatgt

SEQ ID NO: 326319 - DNA, 3234 bp, Homo sapiens
agatttaagcaattctcctgcctcagcctcccaagtagctgggactataggcatgtgccgccacgcccagctaatttttgtattttcagtagagacggggtttcaccttgttggccaggatggtctctatctcctgaccttgtgatccgcccaccttggcctcccaaaatgctgggattacaggcatgagccactgcgcctggcctaattagataatttcttacttgcttcacatacacactggtaaaatctgtttcccctcctgtaaactgtatttagcatagccacagtgacacttgtttaaatgacttagtgtagggtgttttaggagcttttctgtacagaagctttgagggcatggtccttaggttctcaccgctgcactggctcagggtgtccgcccctgccaaggttgggtccctctcttcccatgtgctgcgagggtgctggctgcctgtgagttctttccaaagcttcccggcggaagccttggctgctgactctgctcggtccacaggaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326320 - DNA, 1738 bp, Homo sapiens
ctgtccactgtgacctttccgtggagagaggtgttgtcccatgattttgctgttccaaggccgtccagaggctctgcgggtgggagctcagtgctgctgttctggaatcctcccgtcacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326321 - DNA, 975 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggtaatatgacttcggtgcatgcggtcactgctgttcagctatgtgtatgaatcaaaggttgcattgctacctgggacagcctggtgtgtcatacagtccagtgtgaaggccatgtccctgcgccaagtaatcttgttaagaaaaataaaaaaaaagagattccaggccaagcatggtggctcactcctgtagtcctagcactttgggaagctgaggcaggaggatcacttgacctcaggagttggcttgaccctaggagtttgagaccagcttgggcaatgtagtaagaccacgtctctacaaaaaaaaaaaaaaaaatcaccaggcgtggtggtggcgcacctgtaaacccagctacttgggaggctgagtcaggttcatcacttgaggggctcaaagctgcagtgacccatgatgccatgattgtgccatagaactatggtctgggcaacagaaaaagaccttctctcaaaaaat

SEQ ID NO: 326322 - DNA, 809 bp, Homo sapiens
ctttctgctgtttgtgcccaggtggcagcaccatggatagctccgcaggaagcaaggctaggcgtgaggctggggaggacgaggagggattcctttccaaacttaagaaaatgtttacctcatgatatcccagccgagccgaggtaggaaaaccctggaggttttttttccctttgttttcctctgtgaactaatcctggttttctcccactttaaccaatattgtgcccccacccccaggagttggaacaggtgccagtccaaggtgtggtaaacctagctccactaggagctggcctctcagcctagggaatagatgacgtggcaatcagcctgtagtgcaggactggctgggctgccgcggccagcctctggctgtgtcttcttcctggggaggtggcgatgctggggctgttgtacagcccccctgcagtggtgggtccggcttgcccatggtcacagagggcgagtcaggcagagccaggcctagaactcagatctcctcacgtcctgcctgcttggaagctgccctcctgcgtggacagcgcagggctgtgcaagcctgggggctgctccaggggtagcgcttgctcgccgtgtcatcttgggacccactttggtttattatgctcatctcagcaagtggggttctcgcccctctcttggcacagctgctttccagggattaacagacgctccccacaggggtgtgttcccttgaaatgttgagtataaggtaacagcctatctctttggctcaggaaaaagatccactggaaactaggccgggaagcagcagcccctccaag

SEQ ID NO: 326323 - DNA, 196 bp, Homo sapiens
tagagacggagtttcactggccaggctaatctcgaactcctgacctcaggtgatctgcccaccttgacttcccaaagtggtgggattacaggtgtgagccagcacgcctggcccgttgcttttcttgttgatgttactagcactgttaggagctggagaggtggcctgggcagagtgctgtgggtacctagggcgg

SEQ ID NO: 326324 - DNA, 4027 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326325 - DNA, 2576 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgt

SEQ ID NO: 326326 - DNA, 3638 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326327 - DNA, 3868 bp, Homo sapiens
acagccaaaccttatcagtttgtttgttccttcacagatatagcctggtgggtcatgtactcacagttttcttttgttgagaacattcccagagtgattttctttgttttttcctttttaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaacagctacggctacggagaccactacatccacatcaagatacgagttccaaagaggctaacgagccggcagcagagcctgatcctgagctacgccgaggacgagacagatgtggaggggacggtgaacggcgtcaccctcaccagctctggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccaggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggcccaagcgattctcctgtctcaggcttccgagtagctgggactacaggtgcatgccaccacgcctggctaattcttgtatttttagtagagatggggggtttcaccatgttggccaggctggtcttgaacttctgacctcaggtgatccgcccacctcggcctcccaaagtgctgggattacaggtgtgagccaccatgcctggcccgttgcttttcttgttgatgttactagcactgttaggagctggagaggtggcctgggcagagtgctgtgggtacctagggcaggacatgcctgactcccctcgggagcactcatgctttttgttaattagataatttctttttttttttgagatggtgtctagctctgtctctaggtggagttcagtggtgcaatctccacctcccagatttaagcaattctcctgcctcagcctcccaagtagctgggactataggcttgtgccgccacgcccagctaaattttggtattttcagtagagacggggtttcaccttgttggccaggatggtctctatctcctgacttgtgatccgccaccttggctcccaagatgctgggattaccgggcgttggccagtgcgcctggcctattcagatatttcttacttgcttcacataccgcacgtggtaaatctgtccctcttgtaaactgtatttagattaccacagtgacacttgttgaatgactagggagggggtaggagcttttgtcagaagttgagggatgcccttagtgtcacccgtggcaggtcaaggttcgcccttgccaggtgggtccctctccaagtgcggagggtgcgacgaagtttcacaatcacgagaacagtgtgacttccgcaaagattaagcggcacgactatcccgagaaatgggggggccccacagtaacgaagggatcgcaggtaggaaaacacg

SEQ ID NO: 326328 - DNA, 1425 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctcgaaatgccagccagaaagagatcaagaaagcctattatcagcttgccaagaagtatcaccctgacacaaataaggatgatcccaaagccaaggagaagttctcccagctggcagaagcctatgaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaatacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggtaaggctctgcccgagactccacctcccacggcttgcaccactgactgagaagagctggttgtggcactgctcccagagaacgtatgctgggaattgggggagttggtgaactcagcctggctgtctttcccccgtgaccctgaggagacgagcctgtgctcctctttccctgataccacaggctcagcaaccagagcacagcagctccgggggcggggcgggggattgcatccagttgtcactttcttctttatttttctaacaattgctttggtaattcaaggggaaataatcttttttaaatgtactgttcagctcccaggagtcttcaggtacttctgtagacaggcggtatcatatttttcagtgtcgtgtggtcaagttgatgatctggagtgcagaagtttgtgtgttctagaaaatcagatgaacagattgaggccctgcacctgggttcctaggcagtgtgtttgagtgcacatgcacataaaaaacaagccttaaagagacatttttcttacgcacattgtggtcccagaaccacccatcagtttacctgcgtacttaggtt

SEQ ID NO: 326329 - DNA, 812 bp, Homo sapiens
cgcgcgcccgccgttcccgcgaggcccacctagagccggaatgcgcaggcgcagtgtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggtggagtcttgctctgtcgcccaggctggagtgcaatggcgcgatcttggctcactgcaacctcagcctcccaggttcaaacaattctcatgcctcagcctcccaagtagctgggattacaggcgtgcaccaccatgaccggctaatttttgtatttttagtagagacaagatttcaccatgttggccagcttggtctcgaactcctgacctcaagtgatccacccgcctcggcctcccaaagtgctgggattacaataggcgtgagccaccttgcctggcctagagttgtttctcatgcaaacctaatgggttctttgtttaacatttgcagtggctccctattgctcttaggataaaatccagactccttagcatagctctaaggcccttcctattcctaggccccattaatcgttatcatctctaaccaccactaccaccactgccatctagtttagttataggtataaatctgtatggattcaaagtcctctttagcctatttctgtctctctctcttttttttccat

SEQ ID NO: 326330 - DNA, 2630 bp, Homo sapiens
gagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctggtgagagtgtgtgaagactcagatatcagtgatcttattagctttttcacaagccagaacataatggtgacgatgattaatgacagtgactatgtatccgtggctccccatagtgcggctttaaatgtggtgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtga

SEQ ID NO: 326331 - DNA, 1596 bp, Homo sapiens
agttagcttttgatagattgacttggaagtatgttgagttttttaaaaatatggctgtctactttgaatttgaattcacttaatatttcaataacttggaatattatttttaggcatagtacttgttatttcaaaaaattgttatatattggattaattatgtaacacaaatatgaaataaacatatgagtttctacttacataaataaataattgagtaaagaaatgtgtcagagaagaggtacatcttccttacagaacaattccaaataataatatatgtagataatacccacttcaagggaggaggcttaatctcctatcccccaagtttggacgggacttagccagtttcttgtaaaaaatgaacgacagaaggagaaaaatagtaactttacagttgagaaagctggcaaatactaccttaactaaacgatgttgtgcagatatcatgtattcactgatatgatatgatggaaaaagtactacagctgtgtaatattctctccaaaacccataacccaagtgtagtcatgagaaaaatatcagactaacccaaattgagggaccttctaacacacacctgaccagtacttctcaaaactgtcaaaatcatgaaaaagacagaaagagtaagaaactgtcacccacagttagagactaaggtgacgtgacagccaagaacactacggtatcctggatagaacctggaataaacaaaggacactaatagaaaattggtgaaatctaaataaagtatggagttcagtgacaaggaatgtaccaatgtcggtgtctcagttgtgaggaatttaccatggtaatataagatgataagattagggaaactgaaaccggataaagagtgtatggggatgctgtattttctttgtaatttttctctaaatataaaggtatatttttttaaaatgtagttatatgtgtgagagattattctttgaagctgtcattttatatctgagctttcttttaaaaaattacttcagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtga

SEQ ID NO: 326332 - DNA, 2574 bp, Homo sapiens
gagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctggtgagagtgtgtgaagactcagatatcagtgatcttattagctttttcacaagccagaacataatggtgacgatgattaatgacagtgactatgtatccgtggctccccatagtgcggctttaaatgtggtgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtga

SEQ ID NO: 326333 - DNA, 488 bp, Homo sapiens
atctaaaatagtattcatctttgcatgtaacttttgaaaataatctgtttgaataatgttaatgttaataaatctcttgatacttgttgatataactagatatagccttgtaccatttctgatttagttaaaagttctttgaggtacttgagatacagcatactgtattcatttatttcttttcacctaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataatta

SEQ ID NO: 326334 - DNA, 369 bp, Homo sapiens
aaaccacataaatacaaaacaagtctgcttcttcaaaattctgctggtgagagtgtgtgaaggtctgtgaacgagtgttggcatggagcatggggttgaggggtggataaaggtctggattttaaaactatatttaaggtaaaggcatggtctgtctgcatgaaatctaaattatagttcaatacgtatcttattgatgctgaagaatatattacagtaaattttggtttacaaataaatgacagttttggccaggtgcgatggctcccacctgtaatcccagcactttgggaggccaaggcgggtggatcacctgaggtcaggggatcgagaccatcctggctaacacggtgaaaccccgtctctact

SEQ ID NO: 326335 - DNA, 3464 bp, Homo sapiens
gagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctggtgagagtgtgtgaagactcagatatcagtgatcttattagctttttcacaagccagaacataatggtgacgatgattaatgacagtgactatgtatccgtggctccccatagtgcggctttaaatgtggtgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtatttgtttttattggtaaactttagtgaatctcttctataaaattgtaagtagatcagtgtgtagatttatttagtaacttacctcattgactttggaacatggtaggatatgaataaactctttcaagggttaaattaaaaa

SEQ ID NO: 326336 - DNA, 1827 bp, Homo sapiens
  misc_feature (1690)..(1690): n is a, c, g, or t
gagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctggtgagagtgtgtgaagactcagatatcagtgatcttattagctttttcacaagccagaacataatggtgacgatgattaatgacagtgactatgtatccgtggctccccatagtgcggctttaaatgtggtgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattacttaatgggtacagtgtacattgttgggtgatactctcagatacctgattcaccattgtatagtcttacgcatgtaacaaaactgcatttgtacccctnaatttacatgcacacacaaaagaataaaaataaacttaaaaacttagaaatgaaacaaatctttagtattaatgtttgtgatactgtttgtgtatttagtataagtatttgtaacatttaagacaattttgcctatt

SEQ ID NO: 326337 - DNA, 846 bp, Homo sapiens
ctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaaaaaaaaaaaaaaaaaaaaaaaaaaaacacacaaacaccacaaacacacggggggggcgcgggccaaaaggattcccgcgggggcgccaagacaggggcgccacggttctgggacaacggggggcccaaagggagcaccaaactaaacgcaacacagcggccacgcgtaaacaaggcggcacggggacaacggaaatgggagacccgggaggggcacccccacccggggggcggacaccgtggcccacacccccacggaataaaacgcaacgggggaaacacaaacctacagcggcaacggggccacaccccgccatatgtggccgcgggaaaaacggccacaggagatgacatgcacgctt

SEQ ID NO: 326338 - DNA, 616 bp, Homo sapiens
  misc_feature (521)..(521): n is a, c, g, or t
  misc_feature (523)..(523): n is a, c, g, or t
ctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaaaaaaaaaaaaaaaaaaaaaaaaaaatttgggggggncngggccggaaaaagttttaaaaacattggtggggggggggggcctgtgtgggaagtgggaaagggggccaaggaaaacggggcaggacaagggg

SEQ ID NO: 326339 - DNA, 596 bp, Homo sapiens
tggggtttcactacgttggcgaggctggtctcaaacacctgacctcaggtggtccacctgcctcggcccccacaaagtgagattgggattacaggcgtgagccaccgcacccagcttttcttttcccttccttttcattccttccttcattattggggttggagagagtggatgtaattcttaccttagttaatttctaagactttaatgactgctttctaagttaataattcaggtgttcttttttttttttctcttaatggtgataaagtagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaa

SEQ ID NO: 326340 - DNA, 485 bp, Homo sapiens
ctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaa

SEQ ID NO: 326341 - DNA, 718 bp, Homo sapiens
gctggagtgcaatggcgcgatcttggctcctgcaacctccgcctccgggattcaagcgattctcctgcctcagccttcggagtagctgggattacaggcatgtgccaccacgccctgctaattttgtatttttagtagagatgggatttctccatgttggccacgtttgtctcgaactcccgacctcagatgatccagcctccttggcctcccaaagtgctgggattacaggcgtgagccactgtgcctggcgaaacttatatttttagcgctacactccttgtgtctagattagcacatgccaatataaaagtcttcattatttgttgatagttgttaagtgaattggggttagtaataaaggaaatgttagttacataaattactatgactgattaagtcactgcttatattttataaaatttattttccagaagttacattttcttaagaataaaaaaagaaacaaaaaatgtaatgtaatcttcacattttataaataaaaataatctaagaattttgtattgtgaaaagttcactccattgttttctgtcttccaataaacctggcttaaataaataatttttaaaatataaagtttgcttaaatccacagtaggaaccgcgaaccataaatgacaatattaaattgcaataaaatatttgtaagtatataataaagaataatataactgagaataaaacataatatattaat

SEQ ID NO: 326342 - DNA, 908 bp, Homo sapiens
  misc_feature (729)..(729): n is a, c, g, or t
  misc_feature (779)..(779): n is a, c, g, or t
  misc_feature (790)..(790): n is a, c, g, or t
  misc_feature (825)..(825): n is a, c, g, or t
  misc_feature (841)..(841): n is a, c, g, or t
  misc_feature (855)..(855): n is a, c, g, or t
  misc_feature (863)..(863): n is a, c, g, or t
  misc_feature (867)..(867): n is a, c, g, or t
  misc_feature (869)..(869): n is a, c, g, or t
gctggagtgcaatggcgcgatcttggctcctgcaacctccgcctccgggattcaagcgattctcctgcctcagccttcggagtagctgggattacaggcatgtgccaccacgccctgctaattttgtatttttagtagagatgggatttctccatgttggccacgtttgtctcgaactcccgacctcagatgatccagcctccttggcctcccaaagtgctgggattacaggcgtgagccactgtgcctggcgaaacttatatttttagcgctacactccttgtgtctagattagcacatgccaatataaaagtcttcattatttgttgatagttgttaagtgaattggggttagtaataaaggaaatgttagttacataaattactatgactgattaagtcactgcttatattttataaaatttattttccagaagttacattttcttaagaataaaaaaagaaacaaaaaatgtaatgtaatcttcacattttataaataaaaataatctaagaattttgtattgtgaaaagttcactccattgttttctgtcttccaataaacctggcttaaataaataatttttaaaatataaagtttgcttaaatccacagtaggaaccgcgaaccataaatgacaatattaaattgcaataaaatatttgtaagtatataataaagaataatataactgagaataaaacataatatattaataaaaaaaaaanaaaaatggccttgttgccttagcgggggagctctcgcggccttcccttanggaggtaaatnatgaccccgctactgactcgtgcctcggcgttggntgcgggagcggttcantcactaaggcggantcggtttnccanantcggggataaccacgagaacctgtggaccaagccgcaag

SEQ ID NO: 326343 - DNA, 476 bp, Homo sapiens
gctggagtgcaatggcgcgatcttggctcctgcaacctccgcctccgggattcaagcgattctcctgcctcagccttcggagtagctgggattacaggcatgtgccaccacgccctgctaattttgtatttttagtagagatgggatttctccatgttggccacgtttgtctcgaactcccgacctcagatgatccagcctccttggcctcccaaagtgctgggattacaggcgtgagccactgtgcctggcgaaacttatatttttagcgctacactccttgtgtctagattagcacatgccaatataaaagtcttcattatttgttgatagttgttaagtgaattggggttagtaataaaggaaatgttagttacataaattactatgactgattaagtcactgcttatattttataaaatttattttccagaagttacattttcttaagaataaaaaaagaaacaaaaaatgt

SEQ ID NO: 326344 - DNA, 3365 bp, Homo sapiens
agctgctacgcccaaccagcccagcggcggccattcgcggaaaaagaggcagagcctgtgccagctacagcctcctccgagccaccgcggcggcggaccggcctctcctcccgcctcgcccccacccccacccacctctatcccagtgtctccgtctgagggtttgtcctgttaatgcgggatgagcgatcagaagaaggaggaggaggaggaggcggcagcggcagcggcgatggctacagaaggagggaaaacctctgagccagagaataacaataaaaaacccaaaacctcaggctcccaggactctcagccctctcctctggctttactggcagctacttgcagcaaaatagggactcctggtgaaaatcaagcaactggacaacaacaaattattatagatccaagtcaaggattggtgcaacttcaaaatcaaccacaacagctagaactggtaacaacgcaacttgctggaaacgcttggcaacttgttgcctccactcctcctgcttcaaaagagaataacgtttctcaaccagcctctagttcgtctagttcttccagcagtaataacgggagtgcatctcctacaaaaactaaatcaggtaattcttccacccctggtcaatttcaagtcatacaagtacaaaatccaagtggtagtgtacagtaccaagtaattccacaacttcagacagtggaaggtcaacaaattcaaatcaatccaactagtagttcatctctacaggatttgcagggtcaaattaagctcatttctgcaggtaataatcaagctatactcacagctgctaacaggacagcttctgggaatattcttgctcaaaacctggcaaatcagacagttccggtccaaattagacctggtgtttcaataccactgcagttacagactcttcctggtactcaggctcaagttgtaacaaccctaccaattaacattggaggagtgactctagctttgccagtgataaacaacgtggctgccggaggagggactgggcaggttggccagcctgctgctactgctgatagtgggacttccaatgggaatcaattagtttccacacccaccaacaccactacttctgccagtactatgccagaatctccctcctcctccactacctgcacaaccactgcttcaacgtctttgacaagcagtgacacattagtgagctcagcagatactggccagtatgcaagcacatcagccagtagttctgaacgcaccattgaagaatctcaaacacctgctgctactgagtctgaagcccagagctccagtcagcttcacgctaatggaatgcagaatcagcaggatcaatcaaattctcttcagcaggtgcaaattgtaggccaacctatcttacagcagatccagatccaacagcctcagcaacagatcattcaggctattccaccacagtcgtttcaactccagtcagggcagacgattcagaccatccagcagcagcctttacagaatgttcaacttcaagcagtaaatccgactcaggtgcttatcagggctccaactttaacaccttcagggcaaatcagttggcaaactgtacaggttcagaatattcagagtctttcaaatttgcaagttcagaatgctgggttatcccaacaattaaccatcaccccagtgtcttcaagtggtggcacaactcttgctcagattgctcctgtggctgttgctggtgccccaataactttgaatactgcccagcttgcatcagtgcctaaccttcagacagtgagcgttgccaacctgggtgctgcaggtgttcaagtgcagggagttcccgttacaatcactagtgttgcaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcaaactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagcgctaatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaacccta

SEQ ID NO: 326345 - DNA, 410 bp, Homo sapiens
agctgctacgcccaaccagcccagcggcggccattcgcggaaaaagaggcagagcctgtgccagctacagcctcctccgagccaccgcggcggcggaccggcctctcctcccgcctcgcccccacccccacccacctctatcccagtgtctccgtctgagggtttgtcctgttaatgcgggatgagcgatcagaagaaggaggaggaggaggaggcggcagcggcagcggcgatggctacagaaggagggaaaacctctgagccagagaataacaataaaaaacccaaaacctcaggctcccaggtaaaagcaaacaaattaaaaaaattcatcacgacacattaggagagagagggagttatgccctttgaatgtccagaagtaacagaataaaatgtttatccactca

SEQ ID NO: 326346 - DNA, 528 bp, Homo sapiens
gaatactgcccagcttgcatcagtgcctaaccttcagacagtgagcgttgccaacctgggtgctgcaggtgttcaagtgcagggagttcccgttacaatcactagtgttgcaggtaagttctgacatctttttaagtaccttttaaatagtttttcataacaattattgcttttctctcctaattctaaggtttgacgtagacctctgaagtaaacacacaatcataaggaaccagaaatagcaatattatactaacaaacatagctctgtagtaatcaatgtgacatgttcacttttgtagattttataataatgtgttaaatttgttagttttttaaaaagtattgttttatgggacagagctttctgattagaatcataattgccttctgtaatttagtggtcttatttgagtacattccagctcttcagaaagaaccctagtcgaaatgatatttatctcttctttgagggaaagtagttttaaactgaattggtatatataattgtgagtctgttgaactttt

SEQ ID NO: 326347 - DNA, 702 bp, Homo sapiens
cctagaaccacagagtctgtttcttggctcatgctggaaagccctgctcccagcaggtctgtcctggccttggttcttgtggcatgtggcatgtactcattatctgttgggagcctttgtattcgagccacgaatccagctcttctcccaggaggtgatgtgaaaggaaggagtaaagagcagcttcaaagccccttcttcccctcccgttttccctgttagatttgcagccccgtgttggccaggcctgggaattgggtcattcatagttacagctcagattccccgagcacgtttccaccccacgcacacctcagcttcagacactccataaagcttttggagctgaaacattttcttttctttttacttttgtgaattaggtcattttgagtgtgaagtattatgtttttccttttttctccttccccccagaagtcctgtggttgaaaagttacggacatagaatctatatccgtgactatgacattattcaactggaagagtgattttcagggagaaacgacctaaaactctgagaagaagagaattactgacacattaggcttttagctgatccacgtttagggaccaaggtgacgatagacaaaaacccaaccagatgtttaattgtaattggctgtgctgataaacggcttgagaccagcctgggcaacatagcaagaccctgtctctaaaaaa

SEQ ID NO: 326348 - DNA, 698 bp, Homo sapiens
ttttaggacagattcatatgaacaaataattttaccagattgtaaaaaatgtagaggaatttggactccttagattggtggtccaaatgaaaggctgataaattctgcttgggggccttgattcagagaagacttcaaatagaaaatgcttgaaaggagcaaattagataataaggaaatctttacatactctattgctgttcttattgttgttgtcattagctgtttaagcgtatgcatatgacttatcacatctaagatgcttgaatagttttggatagcatatattcataagaacatttgttaacattaaagtaaacttctagcctggagaagggtagactcaggggtatgcatgatagcatgtttaaataatctgaaggaatgctgtagggtgggtggggtgacaggtttaaactgctccagaatacagaatcaggatcaatgaataaaggttatgagaaggctgatttaccctcactacaaagaagaacctttcaataattaaagcacagcctgggaggaatcttaattgacaaagagaaagtgcagctttgaaagcaaatgcagagagagcttcacagaaaagagagcatggaaaaatcaagccctgaataatgtaatatcatgtgttggtattcagaagccaaaggaagatggtaaaatggtagcagtgacagtggtcctgggagagagat

SEQ ID NO: 326349 - DNA, 1134 bp, Homo sapiens
aaaaaatgcaggattgaggccaggtgtggtggctcacacctgtacttggagcactttaggaggccgaggtgggcggatcacttaaggtcaggagtttgagacgagcctgggcaacaaggtgaaaccctgtctctactaaaaatacaaaaattagctggacgtggtggtgcatgcctgtaatcccagctacttaggaggctaaagcacaagaatcacttgaacctgggaggcggaagttgcagtgagccaagatctcagcctaggtgaaagaatgagactccgtctcaaaaagaagaagaaaaaaatgcagattagtttgggagaaattatcttttcagacctctttgctagaatgcataaatgccattaaaaaaaggattgtattataaccctaacaccagcatatgtacttaaacatgctcctaaaataggtgagtgtgtggttgttggtgactggcataggctttcatagggtaacatacatctacatgcttgcctattcctagactggttagtgacaatatttgggtcctacccctatctctttccttttctttttttctttttttgtaactttcttaccttattttctcttcatttctcagagtcaattctttctcttatctctccaagacctcaccttaaatagttaaggctaacttctgttcctttctcttcctcccaagagaactgtgaattaggtggaaatagcattgaactagcaagagaagcggatcctgtacatgttctcccgtggagttgctgcatgagactcgggcaagtcactcagactcttgggaactgtgaaacaaatccctctcaactcaaatccaattccttctgttccagctcctctatgtgtccctcctggggatcagagggctttctagctcccactctgatgagctgtcattcttaaaacatctctgtagtgcccaccagaaccagtgagccaagatctttggcgagtgtacagctgctcagagcctcaagctttacctctgtaaaatgggttcagcacattgtcaagagatcaaatgggcagatatgtatatatatgctatatatatgttatatacaaactatgatataatatacaatgattatataatatatataagctatacatagctt

SEQ ID NO: 326350 - DNA, 1130 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaaggtaaatagattggtggtgtgtgaaggtgattgactttgtttttcatatatgaagaggcaaatatctctttagactaaaatagtttttgttttttgaaaaaaacaacatgaaaccagctgttcttttctaaaaaaattcctacaatagtttgaaataaataaagttttgatttaaaaaggaaaaaaaaaaaaaaaaaaaaaaattgggggggggcttggcgcccacgaagaaaggtttttctaaaaccctcttgcggtgtggggccggggggccccttttgttctgtgtaccctttgggccacaacgcggtcccaaggagagaccccggccatgcacttagcgggctgggttttcccaccaattaaaaagcgcgcgggggacacggcgtgcttggaaccaaatcccgagggggttcgggggcatagggtctttcacaggggtcccagaactcgtatacgccccgggtaggg

SEQ ID NO: 326351 - DNA, 5892 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttaaaaaaaatt

SEQ ID NO: 326352 - DNA, 5265 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatataca

SEQ ID NO: 326353 - DNA, 4886 bp, Homo sapiens
acctcagttttcatacataacccacatgatccagtctggtaaagaacttatttttaagttggttagcaagtcctagttaaattacagggagagtctggggaagttctgccttggtgttctttatcaccaccagtgaaagaatactttccagttactccttgttgcttttgtttttcattttctgttcagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttaaaaaaaatt

SEQ ID NO: 326354 - DNA, 4657 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttaaaaaaaatt

SEQ ID NO: 326355 - DNA, 2954 bp, Homo sapiens
gtgagacgtgagcgtagtgtgccgcgcaaggctctgtggaagtaaatctttgttgagacgttcgacttgtttttcctttcctctgtattcactaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttaaaaaaaatt

SEQ ID NO: 326356 - DNA, 1737 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagcatcacaactggaaatggagagcccaagctgtgagtttccagccttttctgagtctcaccaggaatggagatgctgatgttgacttaaagctggcagtttaagaatatacttggccttcttgcacctttctgtcttaaccatagaagttctgaagtgtcagtgaccagttgggctaatctgggtcaccaagccgaggaaagacaaatgggaagaaagacaaatctaaggaaagactgatcaaataaacaaatagaattttttattctcaaagcacaacaaatcttattgctatttcacatatagattgggaaaaagaaaaaccttagtctctcgctaatgtttagtgttcttatctttgggtcaactatgtcaaattttgacttaaaattcttatatgctgtaccccacctctt

SEQ ID NO: 326357 - DNA, 6215 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttaaaaaaaatt

SEQ ID NO: 326358 - DNA, 6036 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttaaaaaaaatt

SEQ ID NO: 326359 - DNA, 6087 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttaaaaaaaatt

SEQ ID NO: 326360 - DNA, 4887 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatacttacaaaaaaaagaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaagggaaaaaaaaaactcgacgcggccgcgaatttagtagtagtaggcgaccgc

SEQ ID NO: 326361 - DNA, 1839 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaaggtgaggcaccttccccttctgtccttttagagaaattctcacaatttataattagaagaaactagaacaatttatgtaggacctcatatttaaacatactaaaggtctatcagaattctcagattttaacatattacaaaatattagaaagctgatattaaaaagtgatgccaggcatagtgacagtacctgtagtcccagctacttgggaggctgaggcaggaggatcacttcagcctaagagtttgaggccagcctggagaacatagcaagacatcatcttaaaaaataaaataaaaaataaaaataaataaattttaa

SEQ ID NO: 326362 - DNA, 1550 bp, Homo sapiens
aggggtctccgcccggcgccacccaggtccccaggcgggaagcggctcaactgggaaagcagccggcgcccgtggtctccgggccggccgcccgcgttcttccggccagccccccgcggaggggaggggcgccgacgccgcgttctcggggccccgcagccggcggaagggccgcgcatcgcggaagcgcggcggcagctgaggatcagctgctggaggaggcggagaggcagagggaggagcctcggggggaaggagagggaggggaccgtcaggaagccgcgaacgccgccgagtgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggcaagtatatccttcacatgaatgtactgctattgctggctctgttgacctttggcatgctgtgccctgaggggacagatctttagcagtagaggacaacatttctaacataagctgtgaccaaaggaaatttaaaaataaaaattataaaccagattaa

SEQ ID NO: 326363 - DNA, 280 bp, Homo sapiens
gctggagaggagatcaggggtcttgcaggataaggcgaagaggctggacttttttctaagatcagttgtaggggggacactggaggatctgaggcaggagaagacgagacctgacctatattggggatcgacccctggtcttggggggagaatgggtgcagatgcagggaaggcaaggaagaggctgcacagctgcccagcagagacgacagggcctggactaatgggcagtacaggagctggaggggagggagaggcaccccagagtcaggattgactg

SEQ ID NO: 326364 - DNA, 213 bp, Homo sapiens
ccaaaacaaacaaaaaaatattactactactacgattgctattgttttcgttaaaaagtcttgggacctagaaagcactgaaatttgaatctcttataaaatggctctaaatgggtcaccttaaaatgtagctactgctgggcatggtggctcatgcctgtaatcccagcagtttgggaggccaaggcaggcagattgcttgagcttgggatt

SEQ ID NO: 326365 - DNA, 123 bp, Homo sapiens
ccccaggggaaggaaagaaaaatggcaaaagtggaggttagggcagaaaggaaacagatgcctgtgacctgggcacccaatcagagggagctccctccaagcatattgagggagttgctgtgg

SEQ ID NO: 326366 - DNA, 1996 bp, Homo sapiens
  misc_feature (8)..(8): n is a, c, g, or t
  misc_feature (17)..(17): n is a, c, g, or t
  misc_feature (24)..(25): n is a, c, g, or t
  misc_feature (1879)..(1879): n is a, c, g, or t
  misc_feature (1885)..(1887): n is a, c, g, or t
  misc_feature (1919)..(1919): n is a, c, g, or t
  misc_feature (1950)..(1950): n is a, c, g, or t
  misc_feature (1954)..(1954): n is a, c, g, or t
  misc_feature (1959)..(1959): n is a, c, g, or t
  misc_feature (1967)..(1967): n is a, c, g, or t
gggggttncccggtcgnctggtgnnggacagcgagagattccatcacgctactcagaagggcacaccatttgagacttaaaattctttatttctggaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtatccactgcgggtcttcgaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgaaaaaaaaaaaatncaaaannnaaaataaagtatggcgatagaaattgaacctngcgcaatagatatagtaccgcaaggggatgntatnaccangcataatntagcaaggctcccctatacctcttgcatg

SEQ ID NO: 326367 - DNA, 1453 bp, Homo sapiens
  misc_feature (1336)..(1336): n is a, c, g, or t
  misc_feature (1342)..(1344): n is a, c, g, or t
  misc_feature (1376)..(1376): n is a, c, g, or t
  misc_feature (1407)..(1407): n is a, c, g, or t
  misc_feature (1411)..(1411): n is a, c, g, or t
  misc_feature (1416)..(1416): n is a, c, g, or t
  misc_feature (1424)..(1424): n is a, c, g, or t
ccaatctgaagtgggagcggccgtaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgaaaaaaaaaaaatncaaaannnaaaataaagtatggcgatagaaattgaacctngcgcaatagatatagtaccgcaaggggatgntatnaccangcataatntagcaaggctcccctatacctcttgcatg

SEQ ID NO: 326368 - DNA, 1942 bp, Homo sapiens
  misc_feature (8)..(8): n is a, c, g, or t
  misc_feature (17)..(17): n is a, c, g, or t
  misc_feature (24)..(25): n is a, c, g, or t
  misc_feature (1825)..(1825): n is a, c, g, or t
  misc_feature (1831)..(1833): n is a, c, g, or t
  misc_feature (1865)..(1865): n is a, c, g, or t
  misc_feature (1896)..(1896): n is a, c, g, or t
  misc_feature (1900)..(1900): n is a, c, g, or t
  misc_feature (1905)..(1905): n is a, c, g, or t
  misc_feature (1913)..(1913): n is a, c, g, or t
gggggttncccggtcgnctggtgnnggacagcgagagattccatcacgctactcagaagggcacaccatttgagacttaaaattctttatttctggaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtatccactgcgggtcttcgaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgaaaaaaaaaaaatncaaaannnaaaataaagtatggcgatagaaattgaacctngcgcaatagatatagtaccgcaaggggatgntatnaccangcataatntagcaaggctcccctatacctcttgcatg

SEQ ID NO: 326369 - DNA, 856 bp, Homo sapiens
  misc_feature (739)..(739): n is a, c, g, or t
  misc_feature (745)..(747): n is a, c, g, or t
  misc_feature (779)..(779): n is a, c, g, or t
  misc_feature (810)..(810): n is a, c, g, or t
  misc_feature (814)..(814): n is a, c, g, or t
  misc_feature (819)..(819): n is a, c, g, or t
  misc_feature (827)..(827): n is a, c, g, or t
actatagacgatccccgagtacgctacttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgaaaaaaaaaaaatncaaaannnaaaataaagtatggcgatagaaattgaacctngcgcaatagatatagtaccgcaaggggatgntatnaccangcataatntagcaaggctcccctatacctcttgcatg

SEQ ID NO: 326370 - DNA, 984 bp, Homo sapiens
  misc_feature (896)..(896): n is a, c, g, or t
  misc_feature (900)..(900): n is a, c, g, or t
  misc_feature (902)..(902): n is a, c, g, or t
  misc_feature (905)..(905): n is a, c, g, or t
gcatttccggagcgccagggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagagacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaatttttaccgggncganangcnaggtgaaccctaagaacaccgacggcaggaattggagaaaagccacgacacacagtatggcaacaactacggaagactc

SEQ ID NO: 326371 - DNA, 930 bp, Homo sapiens
tactataaactactgaagaaacataatagcaccactatgctacttttttttttttgctttaaataaatggcaaaatttacattactattagtgtaatgtaagcttgttctttccattcctttctctaaatataattagagctacactgaagtatgaaagcatcttggcactcaatgcatgacttatttcaatcaattgttcacagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaacaccatcatctaaattaatttaccatagactggccctgttcatacaggaatttgtatttggaaaaagttgatttgagaatcgattacatgcccttagaaaataggggtgtctaaaagacccaccctggtgtagactctttatgggaaaaaaggaaaaaaaatctcaaccattttaagataactgatggtttgtaaagttttcaatgcttagttatttaaagaaaatttaattaaaagataggaagtataaagtttgctaacatgttcaaagaactttaaaaaatgatcaaagatatataaacattattgtaattaataggtagttttatgtgtgtatgtgtgtgtgtgtctgtgtaggggacgggagatggtagagaggcaatgccctatagttagctataaaattcagatccagaaagttgggatacaaagatatgaagaatatgacct

SEQ ID NO: 326372 - DNA, 479 bp, Homo sapiens
tactataaactactgaagaaacataatagcaccactatgctacttttttttttttgctttaaataaatggcaaaatttacattactattagtgtaatgtaagcttgttctttccattcctttctctaaatataattagagctacactgaagtatgaaagcatcttggcactcaatgcatgacttatttcaatcaattgttcacagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaacta

SEQ ID NO: 326373 - DNA, 398 bp, Homo sapiens
tgtgctgtggtgatctagaggatcccagtggggaacaatcacttgaacatcacttgaacaatcacttgaacaatcacttgaacaatcacttgaacaatcacttgaacaatcacttgaacaatcacttgaacaatcacttgaactaagtgattgttccccgcgtgggtacctgagctctgaattctgtaatctatgtgtcatatgcttgttgaaaatgaagatgagtttagtgatgaagaagacttcctaaatagcacaaaggctaaactgtaagtttttcctttatttttataagtttttgatacatgtatttcaagtggttaatttaccataaaaatatgaaatgttagcctggggaatgagaaaatcactgccttgggttcttcatggaatggctc

SEQ ID NO: 326374 - DNA, 2892 bp, Homo sapiens
  misc_feature (1996)..(1996): n is a, c, g, or t
  misc_feature (2002)..(2002): n is a, c, g, or t
gcatttccggagcgccagggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagagacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagacgcccaaaaaaggggaaaaaaaaaaaaaaagggaanaccggnaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaacaccatcatctaaattaatttaccatagactggccctgttcatacaggaatttgtatttggaaaaagttgatttgagaatcgattacatgcccttagaaaataggggtgtctaaaagacccaccctggtgtagactctttatgggaaaaaaggaaaaaaaatctcaaccattttaagataactgatggtttgtaaagttttcaatgcttagttatttaaagaaaatttaattaaaagataggaagtataaagtttgctaacatgttcaaagaactttaaaaaatgatcaaagatatataaacattattgtaattaataggtagttttatgtgtgtatgtgtgtgtgtgtctgtgtaggggacgggagatggtagagaggcaatgccctatagttagctataaaattcagatccagaaagttgggatacaaagatatgaagaatatgacct

SEQ ID NO: 326375 - DNA, 2420 bp, Homo sapiens
gcatttccggagcgccagggaagagggaagtcgtggtggtcgcgagggagccggaaagatggtggttaccagatctgcacgggctaaggccagcatccaagccgcgtcggctgaaagttccgggcaaaagtgtgttttctctggtttgcagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagagacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaacta

SEQ ID NO: 326376 - DNA, 689 bp, Homo sapiens
cctcctcccttggcctcctcaaagcactaggattataggtgtgagccactttgccaggctgactaaaaattttaaaacttacagaagtttaaactgttgaaaaacttatataacattctgacattattttaaaaccaattttatgtttttatagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaacta

SEQ ID NO: 326377 - DNA, 2850 bp, Homo sapiens
gcatttccggagcgccagggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagagacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaacaccatcatctaaattaatttaccatagactggccctgttcatacaggaatttgtatttggaaaaagttgatttgagaatcgattacatgcccttagaaaataggggtgtctaaaagacccaccctggtgtagactctttatgggaaaaaaggaaaaaaaatctcaaccattttaagataactgatggtttgtaaagttttcaatgcttagttatttaaagaaaatttaattaaaagataggaagtataaagtttgctaacatgttcaaagaactttaaaaaatgatcaaagatatataaacattattgtaattaataggtagttttatgtgtgtatgtgtgtgtgtgtctgtgtaggggacgggagatggtagagaggcaatgccctatagttagctataaaattcagatccagaaagttgggatacaaagatatgaagaatatgacct

SEQ ID NO: 326378 - DNA, 2399 bp, Homo sapiens
gcatttccggagcgccagggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagagacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaacta

SEQ ID NO: 326379 - DNA, 2026 bp, Homo sapiens
gcatttccggagcgccagggaagagggaagtcgtggtggtcgcgagggagccggaaagatggtggttaccagatctgcacgggctaaggccagcatccaagccgcgtcggctgaaagttccgggcaaaaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaacta

SEQ ID NO: 326380 - DNA, 587 bp, Homo sapiens
  misc_feature (39)..(39): n is a, c, g, or t
aacaaacaaccaactaggctaggtacgaggccgggggtnaatcggccgagggtttaccacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326381 - DNA, 667 bp, Homo sapiens
gaagcacaaaaccatttggtggaagtgataagtcaaatccatgatgtaaccttgtctttcccatcacctgattttttgctttaagccctggttttcaaattaatgatggaattaaagttgatgagggtgaactttgagcattaatagaccttggagcctttccctatgtgactttcattttgagctcttgctgtttggattttaatgacatttctcctttccaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326382 - DNA, 1007 bp, Homo sapiens
gggctaggtacgaggctgggtggtggcgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacttccctcagcaaccggacttagcaggggttgcagtgtcactggcctggggggagtcgaggtggaatttcccaggtgtggtcgacttacgcaaggatgggcgtgggaaaggagtggtggggcccagaaatttggtgaaacacgcaaaaaaacacaaagtttttcacacc

SEQ ID NO: 326383 - DNA, 882 bp, Homo sapiens
  misc_feature (39)..(39): n is a, c, g, or t
  misc_feature (785)..(785): n is a, c, g, or t
aacaaacaaccaactaggctaggtacgaggccgggggtnaatcggccgaggcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttctgaaattttcccccatgagntaaatgtcgattggaaacagtgtcttgttggaagctccctggcaccgggtttcaagaggcggttccggcgggtgggctggaagtcccgggttgtgat

SEQ ID NO: 326384 - DNA, 370 bp, Homo sapiens
  misc_feature (39)..(39): n is a, c, g, or t
aacaaacaaccaactaggctaggtacgaggccgggggtnaatcggccgaggccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326385 - DNA, 1189 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326386 - DNA, 1149 bp, Homo sapiens
cactggtaagttgtacaagggggtattctgaggcagtactatacggtcctatggtagcgaggctgggtggcgcttcctagttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326387 - DNA, 1112 bp, Homo sapiens
  misc_feature (9)..(9): n is a, c, g, or t
aagttttanaaaaagcaggttgtaccgtccggaattcccggatttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326388 - DNA, 1644 bp, Homo sapiens
  misc_feature (1309)..(1309): n is a, c, g, or t
  misc_feature (1311)..(1311): n is a, c, g, or t
  misc_feature (1315)..(1315): n is a, c, g, or t
  misc_feature (1349)..(1349): n is a, c, g, or t
  misc_feature (1644)..(1644): n is a, c, g, or t
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagataaaaaaaaaaaaaaaacctgaggggggcccagtaccaatcgcctatagtgagcgattacaatcactggcgtcgttacacgcggactgggaaacctgcgtaccaactaatcgctgagacatncncttngcagctgcgtatacgaaaggccgaccgacgcttntcacagtggcagctgatggcatgcaatggagcgtaaattggttaaatcggtaaactcgaataagtcatttaacaatggcggaatggaatcctatattaaaggattccgcaaagggttatgtgtcattggaacaagcctcttaaacggcctcactcaagggaaaacccttaagcgagggccttcggacaaccctaaaatattgggtagtcgcaaccaagtgactaagggcccttatttgcgaaaacccctgcaaaagaggggtcttgtaggggcctctcttctttttattatatan

SEQ ID NO: 326389 - DNA, 1410 bp, Homo sapiens
  misc_feature (1410)..(1410): n is a, c, g, or t
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggttatgttgtcctaaagaataaattttggtgataaaaaaaaaagggggagacaaattcctaaggacaattagggaacagttctggaaacgggccaaggacgaataaaaccgcggcccataaacgagcagtgaaagacgtgactggagaacaaatggcggaaatggaacacaagaaactaagacaataagaagagaacaaactaaacataaataaaagacagggacaaacaagaagaaatagaacagaatagaagaaaactaccactatcan

SEQ ID NO: 326390 - DNA, 1349 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaagatacacctttctgtggtaacaaaacacacacaaaaaaatttgcggcgcggggccgaagatttaacacttttggggcggccaaggaaataagtacaggtccaaacgggacagggtttccaaaaacggggcgggtgcacagttgtgtggttatcagcgtgtcccgcgcggtaagggaaaaaatcagtcaa

SEQ ID NO: 326391 - DNA, 1343 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagatacaaaaaaaaagaaccacgagaagagacgcacaacgcaagagaggagcgaaaaagcagaaaaagagggccgaaaaaaatacacggaggacacgataagaccaatacatcaagcgaaagataaaaaaacagggggcgatacaaaagacgcacatta

SEQ ID NO: 326392 - DNA, 1359 bp, Homo sapiens
  misc_feature (1190)..(1190): n is a, c, g, or t
  misc_feature (1234)..(1234): n is a, c, g, or t
  misc_feature (1256)..(1256): n is a, c, g, or t
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagatanaaaaaaaaaagagccaaagctaagacccccgaaaccagacgagnagaaaacgacaacggcatcatnacaacaaccacaccgccaccaggaaagcctgtcctattctagtcaagcacctagggataggcatgcaaattgataacaaaaacaaaagattacaaaactggga

SEQ ID NO: 326393 - DNA, 1070 bp, Homo sapiens
gggctaggtacgaggctgggtggtggcgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326394 - DNA, 1022 bp, Homo sapiens
aggagaggagacatataggctaggtcgaggccgggtgctgtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326395 - DNA, 1012 bp, Homo sapiens
accacgcgtcgcccacgcgtcggaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326396 - DNA, 1136 bp, Homo sapiens
  misc_feature (39)..(39): n is a, c, g, or t
aacaaacaaccaactaggctaggtacgaggccgggggtnaatcggccgaggagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326397 - DNA, 1414 bp, Homo sapiens
  misc_feature (39)..(39): n is a, c, g, or t
aacaaacaaccaactaggctaggtacgaggccgggggtnaatcggccgaggagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaaccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326398 - DNA, 1076 bp, Homo sapiens
  misc_feature (39)..(39): n is a, c, g, or t
aacaaacaaccaactaggctaggtacgaggccgggggtnaatcggccgaggagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaaatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcacccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326399 - DNA, 835 bp, Homo sapiens
  misc_feature (798)..(798): n is a, c, g, or t
  misc_feature (811)..(811): n is a, c, g, or t
  misc_feature (835)..(835): n is a, c, g, or t
cttctcgctttgtttcttctctgtctttcttatccactcttcgtcttccctaggctatttctgccgggcgctccgcgaagatgcagctcaagccgatggagatcaaccccgagatgctgaacaaaggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgagcatacaggcagccatatccgttgcaaagaaggcaattcggtaatcaatcaatcgagcaagtctggtcacttntcataattcaganctatgaaacaatttcacagcaatn

SEQ ID NO: 326400 - DNA, 265 bp, Homo sapiens
tcgagctctgtaccccccgactagcccgaagcacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326401 - DNA, 1028 bp, Homo sapiens
aaggcagtagaggcggtgggaattggcagagggctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgaattaaggttaaggatgggttggctgcagtaacgggggggatggggccaggaaattgggtgaaaaaaaagggtttggggaagaagaggatcttaagggggcagttggaaggct

SEQ ID NO: 326402 - DNA, 1184 bp, Homo sapiens
  misc_feature (39)..(39): n is a, c, g, or t
aacaaacaaccaactaggctaggtacgaggccgggggtnaatcggccgaggagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326403 - DNA, 1108 bp, Homo sapiens
cttctcgctttgtttcttctctgtctttcttatccactcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326404 - DNA, 1407 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagataaaaaaaaacaacacaacacaaacacaccacaaacaacaacacaaaagtcaaacaaagcgaccaacaaagaacccgccacaaaatctctcccccgccgggaagaaaagacgagggtcctaaagaagagaggccccccccccggaaaaaggggggcacccacaaacaaagggaacacacaagaggaggcgcggaggggcccacggaaaaacaggggggca

SEQ ID NO: 326405 - DNA, 1263 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagataagccacagctgattctcattttcttttaccctctcctcaatatgtcaggttattttggtagtaatatatgaatg

SEQ ID NO: 326406 - DNA, 1192 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgaattaaggttaaggatgggttggctgcagtaacgggggggatggggccaggaaattgggtgaaaaaaaagggtttggggaagaagaggatcttaagggggcagttggaaggct

SEQ ID NO: 326407 - DNA, 1678 bp, Homo sapiens
  misc_feature (39)..(39): n is a, c, g, or t
aacaaacaaccaactaggctaggtacgaggccgggggtnaatcggccgaggagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaaatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326408 - DNA, 1136 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326409 - DNA, 1557 bp, Homo sapiens
cttctcgctttgtttcttctctgtctttcttatccactcttcgtcttccctaggctatttctgccgggcgctccgcgaagatgcagctcaagccgatggagatcaaccccgagatgctgaacaaaatgctgaacaaagtgagtggcgtctcgcgccgtctctggccccctcccccgcgagcgccgaggcgggggcgcccaccggttccggcgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326410 - DNA, 1462 bp, Homo sapiens
  misc_feature (39)..(39): n is a, c, g, or t
aacaaacaaccaactaggctaggtacgaggccgggggtnaatcggccgaggagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaaccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326411 - DNA, 1218 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggtcatctttggaatgcatctcttcttaatgacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326412 - DNA, 1058 bp, Homo sapiens
  misc_feature (39)..(39): n is a, c, g, or t
aacaaacaaccaactaggctaggtacgaggccgggggtnaatcggccgaggagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326413 - DNA, 648 bp, Homo sapiens
aatcaacctgcttggaatacgaatgaggccctgcggcgctcgtccatcatcttctgtgcatctggaatagccttggcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326414 - DNA, 1006 bp, Homo sapiens
accgtccgtttccccctcgcttggttctgcccctgctccccctgcacaggcctcacagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326415 - DNA, 706 bp, Homo sapiens
  misc_feature (39)..(39): n is a, c, g, or t
aacaaacaaccaactaggctaggtacgaggccgggggtnaatcggccgaggagtgcgtctggccggcgctttatagctgcagcctgggcggctccgctagctgtttttcgtcttcttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326416 - DNA, 482 bp, Homo sapiens
  misc_feature (39)..(39): n is a, c, g, or t
aacaaacaaccaactaggctaggtacgaggccgggggtnaatcggccgaggcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcacccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 326417 - DNA, 1683 bp, Homo sapiens
acgcagtctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatatt

SEQ ID NO: 326418 - DNA, 537 bp, Homo sapiens
  misc_feature (23)..(23): n is a, c, g, or t
tccttcattttcttcttttcaanaatttgaaacaacaagccaacctatcagtaaccattgaaaagcatttctatttgatgtggtcagtaaaatttatattgcaactgatagtactccggtggatatgcaaacctatgagctctgctgtgatatgatagatgtggttattgacatctcttgtatttatggggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatatt

SEQ ID NO: 326419 - DNA, 5048 bp, Homo sapiens
  misc_feature (2276)..(2276): n is a, c, g, or t
  misc_feature (2278)..(2278): n is a, c, g, or t
  misc_feature (2577)..(2577): n is a, c, g, or t
  misc_feature (2592)..(2592): n is a, c, g, or t
acgcagtctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggananaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctncttctcactggtganaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctgggttggtgtttaaggtttgagcctcccaagggtctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgtacagactggatgtaatttgtaatcaggtatagtccatgttttactttaagcagtacatcacttaataaccattgttaagccattgctttcaagaatgttaactgccaatttaaaagcatgtgtcctaggttcatgctttggtaaagctctcatttcaagtgtattcatagctaagctttctgggagcagaattgtctctttggtgaaaaggaagtacagcctttcctgtttctgaggttgcttaccatacatgtatgtcactgtttcattggccctgttacatccatttggtaaaatttatttgtcctgattaaccagctctcattttatggaaatgatgataaatctcactacttaaatttaatttatgcttttatttttaaactctcttacatctccacatttttgatgggtacatgccagttagggctgtagaactgttacttcagtaaacttcagatattaactcttgctgctgtggccctaatcccctagtcatatgg

SEQ ID NO: 326420 - DNA, 4294 bp, Homo sapiens
  misc_feature (2030)..(2030): n is a, c, g, or t
  misc_feature (2032)..(2032): n is a, c, g, or t
  misc_feature (2331)..(2331): n is a, c, g, or t
  misc_feature (2346)..(2346): n is a, c, g, or t
tggcggttggggaggggaggggaccgcgggcgcgccctgggacctctctcccagaacggtgctgttgaagccagggtcagatgtcgtggctaaaaaaaggcagccggcggcggcgtgactggcagggtcgtcggcagctgcgggtgtcagtctcgccccgcgtcgccgcgggaggggcccacccagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggananaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctncttctcactggtganaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctgggttggtgtttaaggtttgagcctcccaagggtctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaa

SEQ ID NO: 326421 - DNA, 4346 bp, Homo sapiens
  misc_feature (2082)..(2082): n is a, c, g, or t
  misc_feature (2084)..(2084): n is a, c, g, or t
  misc_feature (2383)..(2383): n is a, c, g, or t
  misc_feature (2398)..(2398): n is a, c, g, or t
acgcagtctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggananaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctncttctcactggtganaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctgggttggtgtttaaggtttgagcctcccaagggtctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaa

SEQ ID NO: 326422 - DNA, 384 bp, Homo sapiens
ttacgctaagaccatcctctactgccccctactggcttgtcctggccatgggtcccatgaaaagatggagattatttctacgtgacatttataaatatttttgttctcttctccagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgtta

SEQ ID NO: 326423 - DNA, 455 bp, Homo sapiens
ggatcggtggaaaaggggaaggagggagtaagcgtctgggctggaggagcgcgcgcttctgcccctttcagagccggtgcctcccgcgcccctcaccccaagctctccgcagcgtctggcggttggggaggggaggggaccgcgggcgcgccctgggacctctctcccagaacggtgctgttgaagccagggtcagatgtcgtggctaaaaaaaggcagccggcggcggcgtgactggcagggtcgtcggcagctgcgggtgtcagtctcgccccgcgtcgccgcgggaggggcccacccaggtagtggctggggagacccgcggggcggcggggggatgctcgccaagctgttgtgggagtctccgagaggccgcagatttcccgggatccacgcaaacaccgttgtcaggacaccttatctgctctcggtatcaccacctggacatggcagtg

SEQ ID NO: 326424 - DNA, 4244 bp, Homo sapiens
  misc_feature (1980)..(1980): n is a, c, g, or t
  misc_feature (1982)..(1982): n is a, c, g, or t
  misc_feature (2281)..(2281): n is a, c, g, or t
  misc_feature (2296)..(2296): n is a, c, g, or t
acgcagtctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggananaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctncttctcactggtganaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctgggttggtgtttaaggtttgagcctcccaagggtctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaa

SEQ ID NO: 326425 - DNA, 4540 bp, Homo sapiens
  misc_feature (2276)..(2276): n is a, c, g, or t
  misc_feature (2278)..(2278): n is a, c, g, or t
  misc_feature (2577)..(2577): n is a, c, g, or t
  misc_feature (2592)..(2592): n is a, c, g, or t
acgcagtctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggananaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctncttctcactggtganaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctgggttggtgtttaaggtttgagcctcccaagggtctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaa

SEQ ID NO: 326426 - DNA, 3759 bp, Homo sapiens
  misc_feature (2276)..(2276): n is a, c, g, or t
  misc_feature (2278)..(2278): n is a, c, g, or t
  misc_feature (2577)..(2577): n is a, c, g, or t
  misc_feature (2592)..(2592): n is a, c, g, or t
acgcagtctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggananaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctncttctcactggtganaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttttagagggggggccaccatccgggggcctggggcgggaatcacttgggcccactcatagcccacgggaacccctgggggcccaggggactcctttcacacctagaggcctcccatagatagttagacctaccgcgggtgtgcacacaccagcccgggggaaatctcaaaattggggttggtaaaaccgggatctcccgtgggtggtggcccaagaggggtctcaaactcgggggccccaggaaatgccctctgcggcgctgtaggcctccctccaacaaatgggcggggagtctcacccgggggctggagcactatcgttggtgcccacacgcttcataaatttttcacacactttctctctccgggggtgttctttccaaactctgtcttcttactttctcccccaaaggtccgtgtgctcttttcagaaccgcgggggcaaaccgggacagcaccgagagggaaaactcggggcgcaggggcgtacgaacggaggtattgagcacgccccccacgggggggcccggtcggccaccggagcaaggagcggctatcctacacacaaccaactcaagggggaccgcctacagtcgcttatacaaagagaaacgtcaatatcccgacaacaccgggagttgcgttcagacaccacagaggatcacagtggatatccacaaggacgataccgtagtgagcgcaccttggtgccgacacgaccctcacagcaggcgagcgactaggac

SEQ ID NO: 326427 - DNA, 3933 bp, Homo sapiens
  misc_feature (1669)..(1669): n is a, c, g, or t
  misc_feature (1671)..(1671): n is a, c, g, or t
  misc_feature (1970)..(1970): n is a, c, g, or t
  misc_feature (1985)..(1985): n is a, c, g, or t
acgcagtctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggananaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctncttctcactggtganaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctgggttggtgtttaaggtttgagcctcccaagggtctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaa

SEQ ID NO: 326428 - DNA, 300 bp, Homo sapiens
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagggagcggacatggactacgactcgtaccagcactatttctacgactatgac

SEQ ID NO: 326429 - DNA, 5992 bp, Homo sapiens
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagactttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatacgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgta

SEQ ID NO: 326430 - DNA, 6177 bp, Homo sapiens
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagactttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatacgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcaccca

SEQ ID NO: 326431 - DNA, 712 bp, Homo sapiens
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagactttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgtaagtttgagaacttaaatcactcttaaaattgagtaccattggtcgtgttgtttgcctggtttctctttacagtggcatcacatttattcttcagagcaccattagagtcataccattgaatgaaatttccttcctactcacgttcccaggagatatagtccaagtgaagctccagccaagcaacatcatctttaacttgcctctagagtctcttttcctattcaggcttggaatctgagaatgatatatttctatcccttaggtatagattgatttaaatgacagaatacctggaaactggtagt

SEQ ID NO: 326432 - DNA, 6231 bp, Homo sapiens
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagactttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatacgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcaccca

SEQ ID NO: 326433 - DNA, 6354 bp, Homo sapiens
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagactttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatacgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcacccaaaaaaaaaaaaaaaaaaggggcccgccaaagtacccggggccattcgacccattctgcaaaggccaaagaataacaagcgcccaaaacgaggaagatggcttgcaacattgggaacgaccaaa

SEQ ID NO: 326434 - DNA, 2482 bp, Homo sapiens
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagactttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatacgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatggcacgtggatccacaagggcacgtggatcacaatggcacgtggatcacaatggcacgtggatcacaatggcacgtggatcacaatggcacgtggat

SEQ ID NO: 326435 - DNA, 279 bp, Homo sapiens
cccactgtcccctctctcgggctcagagcctctacccccacgaagtgcctgctttgtgctggatggggttgctgtgcacagttctttgtccctctcttgcatccgtgttgctcactcttactggaaatgcccaggcccttccgagtcctcacttggataactgtggcagcctccagcctcacctccaaccttaggaacctggtgggagacccctgactgcacacagtaccctccatcctcctccccagccttggtcctgcccccgactgccattcagta

SEQ ID NO: 326436 - DNA, 466 bp, Homo sapiens
gtccagggtggttggggaaggtagtgtcccatcacagaggagactagatgcaattttttcctgcccctggtccctagtgtgggagcttggccattcttctggatgtccctggcttgaggaggatctgtactgtgggcctccccagggcctgagcagttgtgcatgttgggctaggaggggcccagactggacatcctgttaagtacagtggcccaagtctcagccagaaagtggacactgggatccaggagggatctaggaggcacctgaatgagtcagagcagcccagtgaataggattagtgagttattatagctctctggcagttgctgcctgctatgccttagttgtaacagagggaagtcacctctgtgactaagaccgggcttatagcaccacagggaactcacccagacctgtgggctttgggtagaggttggctgttcagaggctgtagagccaggca

SEQ ID NO: 326437 - DNA, 416 bp, Homo sapiens
catgatgggtgcacaattgcttattgacatttctacttggattttacataggcatcttaatcttatgacctttcccctggtcctattccagtttttcctgtctctatgaatgaaatcactgcccatcttgttgtacaagctagaaagctgagtcacctttgacacctccctctctttcacctccatattgacccactatggagtcctggcatttgcctcctgaatagcttctaatcttctgcctggtcacgtctaccaccaccacatgacctaagccaccacagtgtcttgtctggactgttgtatttcctaacaaatattcctgcatccactcttactcctatcaatccccaactccaaactcgttgccagactgcagccagtcccagtttggaactcttaatctgataccccaa

SEQ ID NO: 326438 - DNA, 267 bp, Homo sapiens
gttaccaaatctctgacaagcatatattctttccagtcttcacagggcacgcttcggcccttgctaggagtccatcgttctgccataacatttgctcccaggtcatctgcttgcaagaggcaatcgagagtttgggaaacccttacaaaagaaatgacaatagtttatttttagctcctgacattttgtgctcctaatacccagtaagcctttctgccccacagtcaggatgctttaattggcagtaaatggtgaggcggtaaccca

SEQ ID NO: 326439 - DNA, 910 bp, Homo sapiens
gctctgattgaagacagacaacagacctgcccagcctcaagttcccctttctttcccttccccaagatgttccctaagagggctcctcagaatccccaagacttcaaagaatgcagtttaacaccaactcatttgatggtaccaaatggataagcagaagattgtttggttacattttgtggagcagacactgagatggaatttggggtacaacatgagaaagaagcggggatcaggaagaactgagcagaagaccaattaatatgataccgtatgatcaggccgttcaaaactttggccaacctagcagggaattctggaatgagtaatacccgtcatagatgtctcatgttgggccaaactggtcagactttatattcctgtcatacttggccaccagatgtgggctgtaccaggaagcgcatgactttatgcatggcaactctgcatatgatatcaaccctggaggagctaatagtctgaggctgtccactcccagtagcaagatcttccctgcaggaggatctgagcagcacttctccatgtcttccagtctccaaaatacagttcccgaaaacaggattatttttatatatctttttgtccttagtatatgtgcctctaggtacatgcaatcaagctgttgaacagatgatcctcagctcaatggttcaacataccaattttcagctttactatggtacaaaagctatacacattcagtagaaactacaccccaaattttgaattttgatcttttcccaaccagcaatacacagtacaatattctctggagatgttaggcagtggccatgagccataacttccagtcagccatgccatcatgagggtaaacaaatactgtactctgcagtgtactgtattcaataaattacatgagatattaaat

SEQ ID NO: 326440 - DNA, 250 bp, Homo sapiens
agcctcccaaagtgctgggattacaggcgtgagccaccgcgcccggcctgagatcttattttttaaaagcatgtggcacctcccctctcactcttgtcttgctcctgttcccactgtgtgagatgactcactctccctttgctttgtgccgtgactggaagctttctgaggcctccccaaaagtagaagctgctgtgcttcctgtacagccttcagaactatgagccagttaaacctttttttttttttt

SEQ ID NO: 326441 - DNA, 386 bp, Homo sapiens
gccataggggtattataaacggggaggagagtgtgacacattattattattattttaaaagatcattgctgtgtgaagaagtgactgaagggagacaagaataggaggagggagacaaacctgggaggctcttacaataggcaagggcgagagcaaacagtgattaggactggagtgttgataatggaaatggaaaggattagatagattgggatctgtttgggagacaggtttgataggacagactgaatgcggagtgtgaaaataagaaaataatcaagaataagccttagtttttttgtctggatgttggatgttggtgctacctacagaaatgggaaacctgggggaggaacaggtatgtgatagagaatcaacttttattt

SEQ ID NO: 326442 - DNA, 1081 bp, Homo sapiens
gttttccctcaacctctagtactctgtaaagtataccaaaagtcaaggttttaaagaactgtgttacatattagagagaacaaatcaaaagttacctatctccatcgttaccagtagaacattagtatgtattttgaagcaccatttgactctttctatttcagctacttgcttgtcccttgcaaagttattatagtactcttttaaaacttttcttcaagggaagagctattttgacttccttttctttgatctaaacctaacacccagaatatgcttagcagatcatcccaaaacaatcataacttgtttaaattgttcatagcaaaagttacatattataaagagttatgagtgtcttaggcagtgaatagtaactgaatatccttttatagttgtccttcactagcaggaagccttattccctgcccttttacatatcttaacttagaatgttactgtctaaatagtggttaggcaagagtagttcttaaacgtgcagtaattatcttgcactacatttaagggctaaatagctagtagtggtgcttgataattgaagaaatttgtacagctggaggaagtacctgctaaattttcaaaagttacctgaatttaataggtaaatctgtttttaattagagctatatcattttactctgaatgtcttaacatagaagtttacataaaatttacagattggattgatttcagccttcttctggtactttttaaaatcttattaatcattaggaaaagaagttttattattgatgcaagccctaaacactctttcgactccagaggagaagctggcagctctctgtaagaaatatgctgatcttgtgagtatttatttaatggagcaaggaacacagaaaataaaatctatgtgtgcttgataagatttttaaatattattttgatgtaactttaaatgtaaaatgatattttatctcaaaattgaaaacaatctcctttctttagtacttatgattggtgtgtgtgacttcatcttatgaaatgatgtatagaacataataatacttttttaaatgtgaaataaatttcctaaaactta

SEQ ID NO: 326443 - DNA, 750 bp, Homo sapiens
gtggccgcagccagtcggtgagaccgactgagctctggggcttcagttcttgacgctacctacatggctacatctccagccaaggatgagagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacaggtgtgagctagtataccctgcccagtgtttctttcttacttggctttggtgtgaatgagaaaagaatttagtactaaaa

SEQ ID NO: 326444 - DNA, 3547 bp, Homo sapiens
ttttgctgcggaagtcacctcgtggcgtaggggagaggtaacaccgagaagaggcagcggcggtggcccaagacgattggtgccaaacagggcagaacgcaactcagctctgggatatcagtgcacaattaaagaaacttaattgcacctttcaacttggagtataaattttgtatgtatctatgtatatctatgtgtgtattttgtggtttaaggcttatttacataatatgtgacattttacctcagaaattcagtgactgaatttcacagctgcttcccatgcatctttattatctatgtttctgaaaaactcaaatactaactaatctcttttcttcccttagctgttcctttcctgtggttttaaaaaagtgaccagaaactaggtctctattttcattgctttgctgcatattcttttaacctgcttttatcttttacagagttgaggggctttctaaataacctagacaatgtcaagattcttagctgcgttttctgtctaaaagtgtagatgtctagttattcctcatgtaaaacacaacatttcaaccctgagtactataaactttattatgcttctaggttactttttctctttaagcaattattcctacattcctaagtgttcaccagtggaacagataagagatagaagtagttagaaattgagataattgggttgacctgtcattgttgccaggataattactggaagattaagcctatctgttagacattttgaccatgtttataattgttgttagtattctgtcagaatgtatctgttttctagttattaaaagaagcaacagaatcgaggcacaaatatgaagaaatgaaacaagaagaagcacaactgaaagagcagcttttcctttatatggataagtttgaagaattccagactaccatggcaaaaaccaatgaactttttacagccttcaagcaggaaacggaaaagctgacaaagaaaattaaaaaactggaaaaagaaatggtaatatggtataccaaatgggaaaataataatacaacacttctgcaaatggctgaagagaaaactattcgtgataaaaattataaggtctttcaaataaaattggagcggttagagaagctgtacaaggctcttcaaatagaaaggaatgaactcagtgagaaactgggaattctgaaagggcaggtctctgtgaaagtagcagatgtagatttagcagtgcctgtgacgcattcctgtgctgacctggattcttccaatatgctgaacacttcctctaaaagagccccaggagtccatctggaggctgaccccaaaggaatgaatgaagtaaaatgctactcaaaagccctctccacaggatctcctctaggcattgattaagattaagtgtgatcattgtactgatggatatattttgtgtacatgtttctcttttagttgtaactattgattttgtaatgaaaatttcctctcctttttctaccatatctctgtttttttagaactactcaactgtgtggtaacagaaagcttcttaccaatttccccaactatgttgcacatcagcctcattttccccctttattggaatgcatgttttcattgccttctcctttcaaagtgtacgtttgtgtgttcatcaccttaaattatcttaatttgagacttttttataatggtttcgtaatgtgaaatcaaatactaatttaaactctggagcccataatatctacataaaagaaaatataaactgactaatattgtcaagtcatttaaatgataagtaaaacttcaatggattaagaaacaagcatggcatatttgattcagatcagttttttgacaatatttgtatgactttccaaattgatgtgactgtaaactttgaattcctcaaaattgacagaatatatatatatatatatatatatatatatatatatatatatatgtatgtacacacacacagagagatcatttaaatgtaaatgatgttaagaaaaaccaaaacagtagcatatgcaggcaagtcattggaccaataggcttaatatttatgaaactgacaattgttctgctttagtttcaggttacaattatgtttaaagaaaaaaaaatcagtatctagatctctgcacttggcatggaaaattttgaactatttattccttaattttcttttatttcagtttctcatagagctaaatggttttacatatattctcttgtcagatttgtggtctaatagaggtagaaaatggaaattttcccagtacttagaaatatggtacttaggaagaagtctaggatgtgaattacatatacacttcccctagtgactatgataatcaagggggcagatagcagaggaaaataagttaacatgaaatttgacaaattttattactttgccaaaattagcaaaacaaaaatactcaccttcccctgctcaccccccaactttttataaatattcaattcagctacaaaacaaaatactggacccacttctttcagaagagatgaagataccttatatgccctaaagttaataccagcagtcatattttatcagatgtaaatctggatgtaagctcttaatgttatactaaggcagtttcttaggctgtgacacttctttgtggtacttgttttgtgtgaaaggtaaattttggggagaaaacaatgtgaaaaacagaacttgttctgttgtttttggcatactgtttatgttagatacactgtgttacaatacaatattacgaagatctgcattgtattttggaatttggtttcctttcagaattattgctctggctagcattggaaacaacaacaacaacaaaacccaaaggaaccctttgcagaagattcccttgtaaatggccctgtggcatgcccagtatctgcaatgttctagaatagaagttggcaaacctctctgtttgccaagcctgcagagttgaacatgtccataaatgtatacaatctgaccctgttttttggccctgtttctggacactgtagctgaccaagaaaatgtttaaatgttgcgatcaattaaatttttttgttgtatcattctggagttgtaatatgtatagtggcaggggattccaagctatagaaaaaacatgagtctagaatgacagagtgtgtcatcttcaaatgtgtattaatatatttcttgatgatgagaccaatatttctaagttaatggaactattttattacacctgataatcacagttcaattcttgtctgttgcagaattatctacctctttcaaactgtaaatgaaaataactgtgaaaaaaaggatgcagtactgataaaaacactgctttgtttttatctcacctcttttttaaggatatgattttataagaggcagttctcttttgcttttcaagacttctgtagagtttgtgttttttgtttttgtttttgtttttgtttttgtttttttacctaatgtgaatcttattttatctactcaacttcgttcaggttaactaaagatatagatataatggttaa

SEQ ID NO: 326445 - DNA, 3667 bp, Homo sapiens
atttgactatacccatttacccccatggaaatgaaactatattctatgaatgaaaaatgattttaataatgtggtgtattacattttcttcattcaagtaatgtaggccctgagtagagcatgttatgaatatttagttccttagtgttttctcattcaagcctctcatattgaatgagtctagggtttggagagatgtttcacacagcatgtctcttcagtgcaagctgacagatatcagtgcacaattaaagaaacttaattgcacctttcaacttggagtataaattttgtatgtatctatgtatatctatgtgtgtattttgtggtttaaggcttatttacataatatgtgacattttacctcagaaattcagtgactgaatttcacagctgcttcccatgcatctttattatctatgtttctgaaaaactcaaatactaactaatctcttttcttcccttagctgttcctttcctgtggttttaaaaaagtgaccagaaactaggtctctattttcattgctttgctgcatattcttttaacctgcttttatcttttacagagttgaggggctttctaaataacctagacaatgtcaagattcttagctgcgttttctgtctaaaagtgtagatgtctagttattcctcatgtaaaacacaacatttcaaccctgagtactataaactttattatgcttctaggttactttttctctttaagcaattattcctacattcctaagtgttcaccagtggaacagataagagatagaagtagttagaaattgagataattgggttgacctgtcattgttgccaggataattactggaagattaagcctatctgttagacattttgaccatgtttataattgttgttagtattctgtcagaatgtatctgttttctagttattaaaagaagcaacagaatcgaggcacaaatatgaagaaatgaaacaagaagaagcacaactgaaagagcagcttttcctttatatggataagtttgaagaattccagactaccatggcaaaaaccaatgaactttttacagccttcaagcaggaaacggaaaagctgacaaagaaaattaaaaaactggaaaaagaaatggtaatatggtataccaaatgggaaaataataatacaacacttctgcaaatggctgaagagaaaactattcgtgataaaaattataaggtctttcaaataaaattggagcggttagagaagctgtacaaggctcttcaaatagaaaggaatgaactcagtgagaaactgggaattctgaaagggcaggtctctgtgaaagtagcagatgtagatttagcagtgcctgtgacgcattcctgtgctgacctggattcttccaatatgctgaacacttcctctaaaagagccccaggagtccatctggaggctgaccccaaaggaatgaatgaagtaaaatgctactcaaaagccctctccacaggatctcctctaggcattgattaagattaagtgtgatcattgtactgatggatatattttgtgtacatgtttctcttttagttgtaactattgattttgtaatgaaaatttcctctcctttttctaccatatctctgtttttttagaactactcaactgtgtggtaacagaaagcttcttaccaatttccccaactatgttgcacatcagcctcattttccccctttattggaatgcatgttttcattgccttctcctttcaaagtgtacgtttgtgtgttcatcaccttaaattatcttaatttgagacttttttataatggtttcgtaatgtgaaatcaaatactaatttaaactctggagcccataatatctacataaaagaaaatataaactgactaatattgtcaagtcatttaaatgataagtaaaacttcaatggattaagaaacaagcatggcatatttgattcagatcagttttttgacaatatttgtatgactttccaaattgatgtgactgtaaactttgaattcctcaaaattgacagaatatatatatatatatatatatatatatatatatatatatatatgtatgtacacacacacagagagatcatttaaatgtaaatgatgttaagaaaaaccaaaacagtagcatatgcaggcaagtcattggaccaataggcttaatatttatgaaactgacaattgttctgctttagtttcaggttacaattatgtttaaagaaaaaaaaatcagtatctagatctctgcacttggcatggaaaattttgaactatttattccttaattttcttttatttcagtttctcatagagctaaatggttttacatatattctcttgtcagatttgtggtctaatagaggtagaaaatggaaattttcccagtacttagaaatatggtacttaggaagaagtctaggatgtgaattacatatacacttcccctagtgactatgataatcaagggggcagatagcagaggaaaataagttaacatgaaatttgacaaattttattactttgccaaaattagcaaaacaaaaatactcaccttcccctgctcaccccccaactttttataaatattcaattcagctacaaaacaaaatactggacccacttctttcagaagagatgaagataccttatatgccctaaagttaataccagcagtcatattttatcagatgtaaatctggatgtaagctcttaatgttatactaaggcagtttcttaggctgtgacacttctttgtggtacttgttttgtgtgaaaggtaaattttggggagaaaacaatgtgaaaaacagaacttgttctgttgtttttggcatactgtttatgttagatacactgtgttacaatacaatattacgaagatctgcattgtattttggaatttggtttcctttcagaattattgctctggctagcattggaaacaacaacaacaacaaaacccaaaggaaccctttgcagaagattcccttgtaaatggccctgtggcatgcccagtatctgcaatgttctagaatagaagttggcaaacctctctgtttgccaagcctgcagagttgaacatgtccataaatgtatacaatctgaccctgttttttggccctgtttctggacactgtagctgaccaagaaaatgtttaaatgttgcgatcaattaaatttttttgttgtatcattctggagttgtaatatgtatagtggcaggggattccaagctatagaaaaaacatgagtctagaatgacagagtgtgtcatcttcaaatgtgtattaatatatttcttgatgatgagaccaatatttctaagttaatggaactattttattacacctgataatcacagttcaattcttgtctgttgcagaattatctacctctttcaaactgtaaatgaaaataactgtgaaaaaaaggatgcagtactgataaaaacactgctttgtttttatctcacctcttttttaaggatatgattttataagaggcagttctcttttgcttttcaagacttctgtagagtttgtgttttttgtttttgtttttgtttttgtttttgtttttttacctaatgtgaatcttattttatctactcaacttcgttcaggttaactaaagatatagatataatggttaa

SEQ ID NO: 326446 - DNA, 939 bp, Homo sapiens
  misc_feature (198)..(198): n is a, c, g, or t
ttttgctgcggaagtcacctcgtggcgtaggggagaggtaacaccgagaagaggcagcggcggtggcccaagacgattggtgccaaacagggcagaacgcaactcagctctggggtgggttcctgtccagaggggtagagaagagtggctgagggcgcgcctgatctcagcgggaagagtgcgaccccgagggccgcntagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagttaaaaaaaa

SEQ ID NO: 326447 - DNA, 1215 bp, Homo sapiens
gcggccgcagccgtgcgtcccgctcgagcgccagcgcccgcgccccccgatccgcttgccgtggctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggtaataatctctgctctgtggttggatgttgtcacatactggtctttttgttttacattttctgcagcatgagtgattatgaacttggcctgtttggaggtaaatgttgcctggtaaacttgtttcttcacttggtttagtccacctatcatctccagttatgtgtagggaacaaaaatagcaaaatacgaagcccagttataagaaacttaattatttctctgtgtaacaagaactgaagttttaagaaagtttgaggccaatatgatgtaattagtatttgatttaccttgctttttgtacctttgaaaataacctaatagtatgaaaacaatatgtatgctaattttgcttaaaagattatacactgaaatttagagaggatataatgttatctgtagtgtagaaagagttaaataagactgatttttagaatttgttttatcccttccactcttagcttgacaattaggattaagaatatgatatgtcaaatttcatgactgaaatctgaaatgccttaatagttgccctcagtgtttcatccttatactaacatttacattgatatatatgacttatatgtgacactgaaacttggaatttttattcttaatccattttctgttaccctggaagacaaaaaaaaagtatggtaatatataaagtaattgtaattccttgaaaataagacagatatc

SEQ ID NO: 326448 - DNA, 852 bp, Homo sapiens
ttttgctgcggaagtcacctcgtggcgtaggggagaggtaacaccgagaagaggcagcggcggtggcccaagacgattggtgccaaacagggcagaacgcaactcagctctgggtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagttaaaaaaaa

SEQ ID NO: 326449 - DNA, 981 bp, Homo sapiens
  misc_feature (198)..(198): n is a, c, g, or t
ttttgctgcggaagtcacctcgtggcgtaggggagaggtaacaccgagaagaggcagcggcggtggcccaagacgattggtgccaaacagggcagaacgcaactcagctctggggtgggttcctgtccagaggggtagagaagagtggctgagggcgcgcctgatctcagcgggaagagtgcgaccccgagggccgcntagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagttaaaaaaaa

SEQ ID NO: 326450 - DNA, 772 bp, Homo sapiens
ttttgctgcggaagtcacctcgtggcgtaggggagaggtaacaccgagaagaggcagcggcggtggcccaagacgattggtgccaaacagggcagaacgcaactcagctctgggtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacaggtgtgagctagtataccctgcccagtgtttctttcttacttggctttggtgtgaatgagaaaagaatttagtactaaaa

SEQ ID NO: 326451 - DNA, 1200 bp, Homo sapiens
  misc_feature (198)..(198): n is a, c, g, or t
ttttgctgcggaagtcacctcgtggcgtaggggagaggtaacaccgagaagaggcagcggcggtggcccaagacgattggtgccaaacagggcagaacgcaactcagctctggggtgggttcctgtccagaggggtagagaagagtggctgagggcgcgcctgatctcagcgggaagagtgcgaccccgagggccgcntagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttaggtaataatctctgctctgtggttggatgttgtcacatactggtctttttgttttacattttctgcagcatgagtgattatgaacttggcctgtttggaggtaaatgttgcctggtaaacttgtttcttcacttggtttagtccacctatcatctccagttatgtgtagggaacaaaaatagcaaaatacgaagcccagttataagaaacttaattatttctctgtgtaacaagaactgaagttttaagaaagtttgaggccaatatgatgtaattagtatttgatttaccttgctttttgtacctttgaaaataacctaatagtatgaaaacaatatgtatgctaattttgcttaaaagattatacactgaaatttagagaggatataatgttatctgtagtgtagaaagagttaaataagactgatttttagaatttgttttatcccttccactcttagcttgacaattaggattaagaatatgatatgtcaaatttcatgactgaaatctgaaatgccttaatagttgccctcagtgtttcatccttatactaacatttacattgatatatatgacttatatgtgacactgaaacttggaatttttattcttaatccattttctgttaccctggaagacaaaaaaaaagtatggtaatatataaagtaattgtaattccttgaaaataagacagatatc

SEQ ID NO: 326452 - DNA, 1111 bp, Homo sapiens
gtggccgcagccagtcggtgagaccgactgagctctggggcttcagttcttgacgctacctacatggctacatctccagccaaggatgagagtttgtgaatagcacaatggaagaagctggactttgtgggttaagagagaaagcagatatgttgtgtaactctgaatcacatgatattcttcaacatcaagactcaaattgcagtgccacaagtaataaacatttattggaagatgaagaaggccgtgactttataacaaagaacaggagttgggtgagcccagtgcactgcacacaagagtcaagaagggagcttcctgagcaagaagtagcccctccgtctggtcagcaagctttacaatgcaacaggaacaaagaaaaagtcttagagagacaaggtctttccctgtcacccaggctggagcgcggtggtacattcatgggtcatggcagccttaaactccctgagctcgtgatcctgtctcttcagactctagagtagctggggctacaggcgtacaccaccacacatggctaattttttatttttcttttgttgtagagatgggctgtcattctcttgcccaggctggtcttggtatactgtcctgtagcagtatattttggctacctgtactggcattggcttttccaagtgtcaagattacaggaaaagaagttttattattgatgcaagccctaaacactctttcgactccagaggagaagctggcagctctctgtaagaaatatgctgatcttggaaattcacctcttctatagaagagtttgttttgaactatacgatttgaaacaaaattctttttttggagactatggaaacattctcaacagggaaaccctactagactttgtaaagcaaataatggaaaagatacagaactttttgaagaatcatgggaaatttttataattaaataaatgctaaaattctgttttgtgaaacatttatgggaattatcactgacagtttttgtacactttcaaatagtgttaaagcagcaactccatgttgtaaatgcacaaaacaaatatttagttaataatcaactccaagaataaagctgtaacaataatagttaaaaaaaa

SEQ ID NO: 326453 - DNA, 3260 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccacggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacaatgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaata

SEQ ID NO: 326454 - DNA, 918 bp, Homo sapiens
aggcagagctggggcgtggtcagggcttccaacagggcagcgccactcacccctggggagggacatttgggccggtctaacgcccactgtggacggtaaaggccgtttgggaacagctttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacggcaccctttgaccaacagcctagggggagatgccgtgctgcttgctgtttggaagaagtgagaggaaggggtccacctgaccattctccatgtggttcatgaagctgcccaa

SEQ ID NO: 326455 - DNA, 366 bp, Homo sapiens
tcctctcaggctcaagtagtcctcccacctcaacctcccacatagctgggaccacaggcgtgcaccaccacacctggctaattttttcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaata

SEQ ID NO: 326456 - DNA, 3098 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccacggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacaatgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaata

SEQ ID NO: 326457 - DNA, 2599 bp, Homo sapiens
atttctaacgagctcccaggtggcgcgggctgcccgggagcggaccgcaagtccgcgggactcctggggtcttggctccaggccaatcagccgtcaggactcttgataaatcgccctgctcggctaatgagcagaattgccgggacatgcgcgttccggccgaaggggggtaatttccgaactccgggaattcgttgtgtgaagtaggccactcctagggacgcgcggggagcccggtcctcgcgccatgtcgcggcgcaagcaggccaagccccagcacctcaactccgaggagccgcggcctgcgcgccgggagtgtgcggaggtggccccgcaggtggcgggggagccggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggtagcatgatgtaaggaacactcaattttgcagccctccacagacagttacggtagaaggttctccatccccagcccgcgccccattcagtaacttaattataaacgccacattggatttctcaatgagttcctactgtagtaaaacgaaatgcagtttgatctggaggtggcgccaaagatcaagctaactagcccagcctgtgcttgtctgttgtggaattcaaaattctgtttaattctatttggagagaaaagtccaggggcccagtgggccctgagcttggtgctgggtgctgggatatgtgatacgtgggacagcctcacaccagcatctgtttcatcacggaaagcatttagtgtttgctgaacccacaaactactgaaaatccaacctcttctcatagatggacccttaggaggttatgaaatctcagtggatataatacttacccaaagttgcttggtttctacttttggcatctttccttcaaatactctttttaaatataaagtcttgtgtgccctc

SEQ ID NO: 326458 - DNA, 3069 bp, Homo sapiens
gcccacgatagacctactgtccaggtcggggacctcccagtctgcttgccatgaactcgattcaccgagggcgagaagctatcgcagggctcaggtgcaatatttccatggtgcgctagcgaaacggctgcatggatggaagacatgagcgtcccggagcgagtcgcgagtatcgtgcggcgatcatgcgaagtcagcagtttagatgaagcctgtgatgcctcttgtagcgtcacaaggcaagagtggcgtgccagctgacaggcacatcgcggagcaggccacacaagtacgggtccaagtttgtatcgggcaggaaaccacgtgcgcgtgcgcggacaccgaggacgtgcagaccaacacaaccaatgaaccgagtcaaccgtcgggaagaccctaggacgagatcaccaggtttgcgaggcgttgcgcgaggaagtttggttctactttgaagcgagtggctatcgagagagctttagctcgtggcccagcgggacaaggtaactggaaaagagccaggacaagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccacggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacaatgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaata

SEQ ID NO: 326459 - DNA, 2332 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccacggggacatggttaagactgaggctctagagaggaaggacaccggcaggcagagcagccggcaggtggccaagctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaata

SEQ ID NO: 326460 - DNA, 2705 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggtagcatgatgtaaggaacactcaattttgcagccctccacagacagttacggtagaaggttctccatccccagcccgcgccccattcagtaacttaattataaacgccacattggatttctcaatgagttcctactgtagtaaaacgaaatgcagtttgatctggaggtggcgccaaagatcaagctaactagcccagcctgtgcttgtctgttgtggaattcaaaattctgtttaattctatttggagagaaaagtccaggggcccagtgggccctgagcttggtgctgggtgctgggatatgtgatacgtgggacagcctcacaccagcatctgtttcatcacggaaagcatttagtgtttgctgaacccacaaactactgaaaatccaacctcttctcatagatggacccttaggaggttatgaaatctcagtggatataatacttacccaaagttgcttggtttctacttttggcatctttccttcaaatactctttttaaatataaagtcttgtgtgccctc

SEQ ID NO: 326461 - DNA, 3205 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggtagcatgatgtaaggaacactcaattttgcagccctccacagacagttacggtagaaggttctccatccccagcccgcgccccattcagtaacttaattataaacgccacattggatttctcaatgagttcctactgtagtaaaacgaaatgcagtttgatctggaggtggcgccaaagatcaagctaactagcccagcctgtgcttgtctgttgtggaattcaaaattctgtttaattctatttggagagaaaagtccaggggcccagtgggccctgagcttggtgctgggtgctgggatatgtgatacgtgggacagcctcacaccagcatctgtttcatcacggaaagcatttagtgtttgctgaacccacaaactactgaaaatccaacctcttctcatagatggacccttaggaggttatgaaatctcagtggatataatacttacccaaagttgcttggtttctacttttggcatctttccttcaaatactctttttaaatataaagtcttgtgtgccctc

SEQ ID NO: 326462 - DNA, 1998 bp, Homo sapiens
cagttgtcccatctgtaaagtgggggtaatagtacccactcataggattgttgtgaggattgcattaatatgcacaacaagtgttgtcattaggaggttgggtttagagttcacaaaacccaaccatctcatggcggccaagtgtgctaaggcaggttggggtgggagggtctgttttgcctgcctgttctaatggaaacacaccttccattgctaggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggtagcatgatgtaaggaacactcaattttgcagccctccacagacagttacggtagaaggttctccatccccagcccgcgccccattcagtaacttaattataaacgccacattggatttctcaatgagttcctactgtagtaaaacgaaatgcagtttgatctggaggtggcgccaaagatcaagctaactagcccagcctgtgcttgtctgttgtggaattcaaaattctgtttaattctatttggagagaaaagtccaggggcccagtgggccctgagcttggtgctgggtgctgggatatgtgatacgtgggacagcctcacaccagcatctgtttcatcacggaaagcatttagtgtttgctgaacccacaaactactgaaaatccaacctcttctcatagatggacccttaggaggttatgaaatctcagtggatataatacttacccaaagttgcttggtttctacttttggcatctttccttcaaatactctttttaaatataaagtcttgtgtgccctc

SEQ ID NO: 326463 - DNA, 453 bp, Homo sapiens
tttcgtaaggcagtgggaaataagccttttccttttttaatcttgtttcctgctgccatctgtgtgtgtatgtgtttgaaggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggggtgagtcctgcctgttatttgctctctacgctcctcactttctatggcataaatcataagcaccttaaagcattcagccacaatgtaagaaatcgagttggaacctttgctcatcccgt

SEQ ID NO: 326464 - DNA, 1104 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagatggagcctcgctctgttgcccaggctggagcgcaatgacgcgatcttggcccactgcaacctccgcctcccgggttcaagcaattctgcctcagcctcccgagtggctgggattacaggtacccaccacacgcccagctaattttgtatttttagtagagacaaagttttgccatgttggccaggctggtctcgaactcccgacctcaggtgatccgctgctcagcaccaaaagtgttgggattacaggcgtgagccaccgtcccggccctaaaatatattttctatatataaaagaggttagccctttagctgatcattaattaacaatgttctttgagctcctccccttcacctggtctgtggtggtggccggggcacgcggggccgaaacacggtggggcccttatctctcgcaaaaaaaaagctttaatttaaatttacacgaggagggggtaag

SEQ ID NO: 326465 - DNA, 3597 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccacggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacaatgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaataaaaaaaaaaaaaaaaaaaaaaaaaaaaaaaaaaaaaaaaaaaaaaaaggggggggggggaaaaatatatcccacgagaggggggcccacagtttaagcggggcgaccaaaggtttcttggaacaaggggggcccacataagagggagagggcagtattataaaacagatgaagcaaggggcgcggggtttacaaacaagtgggtgagggggaaaacaggtgaacagggggaaacctgcgggagagagagaaaaccctcaagacggcgggggggagggacaacacaaggggggggcaacaacgtatctcctacagagagaaagtttttatgaggcgccttaagaggggagaaaattgtacaaattttcaagggggtggataaatggggggggtaaaaaacacgagggtggaacaataatgtgcgatcggggcatagaaaaaattgtgcgctacaaggagaaattatgtgattcttgatagaagatttttttacagggagc

SEQ ID NO: 326466 - DNA, 2969 bp, Homo sapiens
ggcagacaaagcctgtaggaagtgagtggccttctccaagccaagccccaagggatgacagagccataagacagaaggggtccgggcctttgatggagaacctcctactgacgttccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccacggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacaatgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaata

SEQ ID NO: 326467 - DNA, 3367 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggtagcatgatgtaaggaacactcaattttgcagccctccacagacagttacggtagaaggttctccatccccagcccgcgccccattcagtaacttaattataaacgccacattggatttctcaatgagttcctactgtagtaaaacgaaatgcagtttgatctggaggtggcgccaaagatcaagctaactagcccagcctgtgcttgtctgttgtggaattcaaaattctgtttaattctatttggagagaaaagtccaggggcccagtgggccctgagcttggtgctgggtgctgggatatgtgatacgtgggacagcctcacaccagcatctgtttcatcacggaaagcatttagtgtttgctgaacccacaaactactgaaaatccaacctcttctcatagatggacccttaggaggttatgaaatctcagtggatataatacttacccaaagttgcttggtttctacttttggcatctttccttcaaatactctttttaaatataaagtcttgtgtgccctc

SEQ ID NO: 326468 - DNA, 2840 bp, Homo sapiens
aggcagagctggggcgtggtcagggcttccaacagggcagcgccactcacccctggggagggacatttgggccggtctaacgcccactgtggacggtaaaggccgtttgggaacagctttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggaccgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggtagcatgatgtaaggaacactcaattttgcagccctccacagacagttacggtagaaggttctccatccccagcccgcgccccattcagtaacttaattataaacgccacattggatttctcaatgagttcctactgtagtaaaacgaaatgcagtttgatctggaggtggcgccaaagatcaagctaactagcccagcctgtgcttgtctgttgtggaattcaaaattctgtttaattctatttggagagaaaagtccaggggcccagtgggccctgagcttggtgctgggtgctgggatatgtgatacgtgggacagcctcacaccagcatctgtttcatcacggaaagcatttagtgtttgctgaacccacaaactactgaaaatccaacctcttctcatagatggacccttaggaggttatgaaatctcagtggatataatacttacccaaagttgcttggtttctacttttggcatctttccttcaaatactctttttaaatataaagtcttgtgtgccctc

SEQ ID NO: 326469 - DNA, 1713 bp, Homo sapiens
  misc_feature (1)..(1): n is a, c, g, or t
  misc_feature (5)..(5): n is a, c, g, or t
  misc_feature (7)..(7): n is a, c, g, or t
ngcangnggggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggtgagtccctgaccaggaaacctcaatcccttactttttctctaatttcttaaccttcatttacttaacaacacaagcaacttaaatgacttggtgtggtagaagtacaagaatttggaacttctgt

SEQ ID NO: 326470 - DNA, 324 bp, Homo sapiens
gggacagcattgagcatattttgacatcctcagctttgccgttttgtggttataatgatgtgttgggtcagttatttaaggatgcatttgatggtgagaggacagaggtgcggaagagtattctagatgttatacactggtaaatagggtagcttctggagaagtcagcagagagagcacccaaataattctgcagcactgacaggcgagtggagtctcggtgaacttctctacccgtctctgccctggaggactggagtcagcactgggcattgctcttaatttacagacaaggtgacagactggtgggtccagaggaagatg

SEQ ID NO: 326471 - DNA, 877 bp, Homo sapiens
gggctcagagctcgccgccaaggggcgtggcctccgggccgcggcggcctctgggagttgtagtcccgcctcaacttgtggtggcctctttaaaaaaacaaaaaacaaacaaacaaaaaaacactggcgcttgggtccgtcgctgcctcggtgtccctgtcgggcttcccagcagcggcctagtggaaaagtaaaagatgtctgaatatattcgggtaaccgaagatgagaacgatgagcccattgaaataccatcggaagacgatgggacggtgctgctgtccacggttacagcccagtttccaggggcgtgtgggcttcgctgcaggaatccggtgtctcaatgtatgagaggtgtccggctggtagaaggaattctgcatgcccccgatgctggctggagaaatccggtgtatgttgtcaactatccgaaagataacaaaagaaaaatgggtgagacagaagcttcatcagcagtgaaagtgaaaagaccagtccgatttaatagtgttgggtctcccatggaaaacaactgaacaggacctgaaagagtactgtagtacctttggagacgttcttatggtgcggcaaagccaagatgagcctttgagaagcagaaaagtgtttgtggggcgccgtacggaggacatgactgaggatgagctgtgggagttcttctctcagtatggggatgtgatggatgtcttcgtccccaagccgttcagggcctttgcctttgttccatttgcagatgatcagattgcgcggtctctttgtggagaggactcgatgaaaggaatcagcgttcacatatccaatgccgaacccaagcgcaatagcaatagacagcaagaagtggaagatttggtggtaatcc

SEQ ID NO: 326472 - DNA, 743 bp, Homo sapiens
tccagacggctactgatccatcatgcctcaaacagtgcctggcacataataaatattgttgactcaaagaaaagtgaatttgtttggagaattatctcttggttgacacttggttgactgctctgtcttttctaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaaggtatgtgcttaaatctcctgtgttattcttgagaactcagccttggtttctatttcagatcttatttaccatctcacattctcactaacaaaggaaacacagtgcctcctggatgtgatttcttcagtggactctttctgaaggagacttgattacagccatatgatgggtctgtgagttacctttttataaaccaatacaacacaagattatataaaaggaaaagaccaatgtttgcagtgtaaagtgcctccaaattcttgcttactgtggtgatgactggcattcttcccagtgggagtctggagatttctttatgctttctggaaattataacattacctttctattttcaagacaatcaaatcactgtagtcttgaataatataaggaagtttttaaaattaaaatctaatcagtatcttttg

SEQ ID NO: 326473 - DNA, 2211 bp, Homo sapiens
gttgtcagagtagagcatacgatgggggtttctgctctggagcaatgtatccacatgacttcccaacaactttccacactgagcttggggcctgtgaggactgggggaccctcctgtagcaataaaatgtgccactcacatctgtggtagtgatggggaccaccaagggtctctagattacctttttgctgcaagaataagtcccctttgactccaatctgatccctgcaggagagatagtgtggccaaggcagaatgctttgctctcctctctatgttggtatactaggtttctgtggtccagaggtattttgtcatttccgtgttgcttcataacatacttcctcagtcactgcagtcaaacagtagttgtagttgtttatttgttgttttgtttcctttttgtcaggggatgagagccaaataagtctagttagcctcttgctgacatcactctagctctctgaaacagttattttccttgttctctaacaatgtcaattttcttaaaatttctaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttactgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcattttaaaaaagg

SEQ ID NO: 326474 - DNA, 1038 bp, Homo sapiens
  misc_feature (57)..(57): n is a, c, g, or t
gatcttattatgaccatatcatctggtgcgtggcaccttgattggtgtacgtgtatncctggatctagtcactagtgtctgctgtcgtccaatatactcttggatcctcgtacatatgtgctgtggaatatcttacaagcattttagaaaccagacagctgactgctttaaacgatacgatgcatgaatgtattccaaggtagagacgattcttgatcgattcataactttgtgacctttttcatttgagtgtctcgtagtctaacacgaatgtcagatttgactccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttactgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcattttaaaaaagg

SEQ ID NO: 326475 - DNA, 2009 bp, Homo sapiens
tccagacggctactgatccatcatgcctcaaacagtgcctggcacataataaatattgttgactcaaagaaaagtgaatttgtttggagaattatctcttggttgacacttggttgactgctctgtcttttctaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttactgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcattttaaaaaagg

SEQ ID NO: 326476 - DNA, 591 bp, Homo sapiens
tcttttttttgagacgttagaaattttgtataaaaaggaggataaaacagttcattctctgtccagtcaatagctatggtaactatttagtatgatgaagatgccgtaagatatgaaattaatgaacaattgtcctaattttcagtaaacattattattttaaggcctctattgctcaagtctcctattgtttaaatttttatcttcctttccttttgaatgctagatttaatgactcaagtgttcacgtcagaattttccccttttatgtagccctctcaaaccccacagttcacatccacttgaaacacacataattataaaagatgagagaccaattattatcttctctcctcccctgtatcctcacaggtgcctggctacttcaagagttgagctaatcacagggaagattcagtctcagttcagctgcctcatttgatcagctcaagactgagtccaacaaaagtggtctgtctaatgaaactcattttcattttttctcattagtctatacacgattgagactgtagaacgacaaaagaataaaaagaagaatgacaattaaaaatcattttctctggcccttga

SEQ ID NO: 326477 - DNA, 316 bp, Homo sapiens
gctttccccaggggcaaccagcccagttcaatttgcctgggggcttttgactctacaatctcttccaacattaaacaagtgaatcctgcgcaccctggtgcctggctacttcaagagttgagctaatcacagggaagattcagtctcagttcagctgcctcatttgatcagctcaagactgagtccaacaaaagtggtctgtctaatgaaactcattttcattttttctcattagtctatacacgattgagactgtagaacgacaaaagaataaaaagaagaatgacaattaaaaatcattttctctggcccttga

SEQ ID NO: 326478 - DNA, 289 bp, Homo sapiens
agacttcagaagaactgacccaaggacaaaggtccacccaggccatggaagaggctcctcaaccgtttgggtgcctggctacttcaagagttgagctaatcacagggaagattcagtctcagttcagctgcctcatttgatcagctcaagactgagtccaacaaaagtggtctgtctaatgaaactcattttcattttttctcattagtctatacacgattgagactgtagaacgacaaaagaataaaaagaagaatgacaattaaaaatcattttctctggcccttga

SEQ ID NO: 326479 - DNA, 574 bp, Homo sapiens
gtattgatattaagaattacgtatatagatggacatttacaatttgtcagaggtttttctcaagtaaattattaaattagtattacttttttctctggagaaacaaaaccgttgcaaaatgtaatcttctataatgatttttttaaaaaaagtttctactgttgaaatatgtgcctggtgtaatgaaagggaggttgtacaataatccaaacaaaattaaattaacttctgtgaaggaaaagtcatttagtttttgagagattatattcctttgaactggaatgattttaaagtgatttatattaccaagaaaattaccatgtcaaaacggaaaaggaaatccttgcattggacactggtgattttgcccatttaagacatctttggggtgactttttaacttgagagaaaactcagggcatacaaacgattgtgaagaaaaaaatagaagaggcttctattctctagttcattactccttagctttaaaaattatttctttcacaaggatattttattgatgacttacctgaaggcacaaaacatttggtgtttttaaaaacacaccatctgc

SEQ ID NO: 326480 - DNA, 455 bp, Homo sapiens
agaactcagtatgtttgttgaatgattcttacatgatacctcttaacacaggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326481 - DNA, 978 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggagttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326482 - DNA, 1055 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtggaaaaaaaaaaaaaaaaaaaaaataaaaaataaaaaaaaaaaaccccggggaggcacacagagcggggggaggaaacacaagggtttaaaagcgaccaggagaaaatagtagtgtcacaggacccaactctatggtcacgagggggaaacaggcgggccacaataggagacgcgagaatcggacaccgaggtcgtgatacggcaaca

SEQ ID NO: 326483 - DNA, 817 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326484 - DNA, 930 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtggacacaaccagaacacaaaaacgggggggcggcaaaaatacccgaaggggccgttacgcgccccttcttggacagggcctag

SEQ ID NO: 326485 - DNA, 1304 bp, Homo sapiens
  misc_feature (931)..(931): n is a, c, g, or t
  misc_feature (1081)..(1081): n is a, c, g, or t
  misc_feature (1176)..(1176): n is a, c, g, or t
  misc_feature (1237)..(1237): n is a, c, g, or t
  misc_feature (1256)..(1256): n is a, c, g, or t
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtggaacctccacgagggttcagctgtctcttacttttaaccagtgaaattgacctgcccgtgaagaggcgggcatgacacagcangacgagaagaccctatggagctttaatttattaatgcaaacagtacctaacaaacccacaggtcctaaactaccaaacctgcattaaaaatttcggttggggcgacctcggagcagaacccaaccttcgagcagtacatgctaagacttnaccagtcaaagcgaactactatactcaattgatccaataacttgaccaacggaacatgttaccctagggataacagcgcaatcctattctagagnccatatcaacaatagggtttacgaccttgatgtggatcaagacatcccgatggtgcagccngtattaaggtccgttcgtncaacgtttaaagccttacggatctgagttcagaccggggaaattcagg

SEQ ID NO: 326486 - DNA, 1250 bp, Homo sapiens
  misc_feature (931)..(931): n is a, c, g, or t
  misc_feature (1027)..(1027): n is a, c, g, or t
  misc_feature (1122)..(1122): n is a, c, g, or t
  misc_feature (1183)..(1183): n is a, c, g, or t
  misc_feature (1202)..(1202): n is a, c, g, or t
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtggaacctccacgagggttcagctgtctcttacttttaaccagtgaaattgacctgcccgtgaagaggcgggcatgacacagcangacgagaagaccctatggagctttaatttattaatgcaaacagtacctaacaaacccacaggtcctaaactaccaaacctgcattactaagacttnaccagtcaaagcgaactactatactcaattgatccaataacttgaccaacggaacatgttaccctagggataacagcgcaatcctattctagagnccatatcaacaatagggtttacgaccttgatgtggatcaagacatcccgatggtgcagccngtattaaggtccgttcgtncaacgtttaaagccttacggatctgagttcagaccggggaaattcagg

SEQ ID NO: 326487 - DNA, 1529 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaaagtgagtagtgtgggccccttctgccccatcctatgtcctctatcccctttgcccaccctctctagctaacaactggattcagcatgcagagaatagtttcaaatagtggattaggaacattaggatggcgtgaggcatgagcctaggttgggaggcagagtgcaagtgggatgtatggagggaaggctgtgacctaggatgaagggaagaggttgggcagcccttgacagtgagctctgtgcaggaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326488 - DNA, 796 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326489 - DNA, 1371 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaaggtaagagagataagaggtgactagggaaggggtgatggcacactgactactggatgagaaagggcctgaatcccctctttctcacagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326490 - DNA, 1287 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaaagtgagtagtgtgggccccttctgccccatcctatgtcctctatcccctttgcccaccctctctagctaacaactggattcagcatgcagagaatagtttcaaatagtggattaggaacattaggatggcgtgaggcatgagcctaggttgggaggcagagtgcaagtgggatgtatggagggaaggctgtgacctaggatgaagggaagaggttgggcagcccttgacagtgagctctgtgcaggaggactccctcaatgtggctgacttgacttccctccgggccccactggacatccccatcccagaccctccacccaaggatgatgaggtgaggcactcagggtgcaggacttggactataaacccaatggagaagatagcccttcaacctctgtgacttttctaaagctactttcccccctttttgccttagatggaaacagataagcaggagaagaaagaaggtaagagagataagaggtgactagggaaggggtgatggcacactgactactggatgagaaagggcctgaatcccctctttctcacagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326491 - DNA, 1153 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtagtgagtggatagtccaccagccttttagctgggtgtgggacgaggaggtgtggaggaagaagtcctccttgtcttgtttgtgactttcccaatgtggagaatattaagctaaaagcattacctagaaaaactggtttgggcttcaacaaccttgacccttttctctgctcagtcctttgggatcctatttcttggtgctaagaaggggttcattctcaagttaacctatttcctataaaaggaaaccagactcatgtcccagcctcccatgggactgactcagctttgcctcccacattgcagatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326492 - DNA, 1315 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtgagggcagctggaggaccagcattgggggcagtaggagcatttctttgggacccccagagctgggcagccctatcaggatgatgggagactttgggaagggtctgagggagtacatctccctgaacactcattcctgtggtattcccttgcttctggcaggtacttctcagaacgtggggatgctgtggccaaggcctccaaggagactcatgtagtgagtggatagtccaccagccttttagctgggtgtgggacgaggaggtgtggaggaagaagtcctccttgtcttgtttgtgactttcccaatgtggagaatattaagctaaaagcattacctagaaaaactggtttgggcttcaacaaccttgacccttttctctgctcagtcctttgggatcctatttcttggtgctaagaaggggttcattctcaagttaacctatttcctataaaaggaaaccagactcatgtcccagcctcccatgggactgactcagctttgcctcccacattgcagatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326493 - DNA, 1488 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaaggtaagagagataagaggtgactagggaaggggtgatggcacactgactactggatgagaaagggcctgaatcccctctttctcacagtccctaagtgtggatttctccctgggaatgagaaagtcctgtccctgcttgccctggttaagccagaagtctggactctcaaagagaaatgcattctggtaagcctgggaaatgggggaagcagaaagagaagacacacaaggtgaggccctggactcctccgtagatacaagtccttcatacagagacctagtcctgaaaaagaaaacttccttctgtgccttgggcttagatcccctttgttctcctcgttctgttagacctctcttatcacaacggtacccccaaaattagagactgtgcagtatccactctgtaacctcagaacctactgctgtattgggttcatagtagaggtggtatgatatagtgagtgaattgttttaaaagattggaccctagagagagactgcttaggttcaaatcgtgattctatcagttacctagctggtagccttaagtaagtcacttagacattctgtgactcagttttttcatctgttaaatggggtacaataaatacatatctctggaaggttgctgtgatggattacatgaaattaaatacatggcacagtacctggtatgtaataagtacccaattaaatataactttttt

SEQ ID NO: 326494 - DNA, 1220 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaagaggactccctcaatgtggctgacttgacttccctccgggccccactggacatccccatcccagaccctccacccaaggatgatgaggtgaggcactcagggtgcaggatccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326495 - DNA, 1107 bp, Homo sapiens
tgatacacccttccaccttttcacttaaagggagcatttaaagcttctgaatgccagcatcacaactcttgtgtttgggggccattataagtaaaataaggttacttgaacataagcactgtgataccacagcagtcgagctgataaccgagatggctacacagtgactaacggcaggtggtatagtataccaccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtaagcctgggaaatgggggaagcagaaagagaagacacacaaggtgaggccctggactcctccgtagatacaagtccttcatacagagacctagtcctgaaaaagaaaacttccttctgtgccttgggcttagatcccctttgttctcctcgttctgttagacctctcttatcacaacggtacccccaaaattagagactgtgcagtatccactctgtaacctcagaacctactgctgtattgggttcatagtagaggtggtatgatatagtgagtgaattgttttaaaagattggaccctagagagagactgcttaggttcaaatcgtgattctatcagttacctagctggtagccttaagtaagtcacttagacattctgtgactcagttttttcatctgttaaatggggtacaataaatacatatctctggaaggttgctgtgatggattacatgaaattaaatacatggcacagtacctggtatgtaataagtacccaattaaatataactttttt

SEQ ID NO: 326496 - DNA, 1032 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctggggcaaggagaagtgatgtaaatgggggagtaacatgatgagataaatggattagagacatggctcaggctgctgtagagaaggcaccagggagagcagatggctcaatgggtgtgcatggagacctctcactgagctaagggagaggtttttaccccacgacgaacttcgacgtacatttaaatgatgatgggaaggagctaaaagtaggggataggttacagat

SEQ ID NO: 326497 - DNA, 638 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326498 - DNA, 886 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggagttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaactcagggccatggtgctggacctgagggccttctatgtgagtgtggagtaaggctttaggggaggtggatgagtgggggcaggcaggggattggctaagaacctgactcttgcactctggccttctcccagctgagctttatcatatcatcagcagcaacctggagaaaattgtcaacccaaagggtgaagaaaagccatctatgtactgaacccgggactagaaggaaaataaatgatctatatgttgtgtggaattcccttctggcgtgtgtcattcattcaaaaagcatttattgagtggcacctatgtccagcctgaagatgaatgtggtgggaaggggtgggtgtcacaaagacaaagatgacttagatgcccactgtaatcttgactgtgagaaagaggggattcaggccctttctcatccagtagtcaatgtgccatctccccttccctagtcacctcttatctcacttaccttctttcttctcctgcttatctgtttccatctaaggcaaaaagggggga

SEQ ID NO: 326499 - DNA, 565 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctggggcaaggagaagtgatgtaaatgggggagtaacatgatgagataaatggattagagacatggctcaggctgctgtagagaaggcaccagggagagcagatggctcaatgggtgtgcatggagacctctcactgagctaagggagaggtttttaccccacgacgaacttcgacgtacatttaaatgatgatgggaaggagctaaaagtaggggataggttacagat

SEQ ID NO: 326500 - DNA, 850 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326501 - DNA, 990 bp, Homo sapiens
tgatacacccttccaccttttcacttaaagggagcatttaaagcttctgaatgccagcatcacaactcttgtgtttgggggccattataagtaaaataaggttacttgaacataagcactgtgataccacagcagtcgagctgataaccgagatggctacacagtgactaacggcaggtggtatagtataccaccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326502 - DNA, 912 bp, Homo sapiens
  misc_feature (872)..(872): n is a, c, g, or t
  misc_feature (882)..(882): n is a, c, g, or t
  misc_feature (889)..(889): n is a, c, g, or t
  misc_feature (892)..(892): n is a, c, g, or t
  misc_feature (897)..(897): n is a, c, g, or t
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtggacacacacacaacacccaaaaanacccgggccncttttgnggnggggnaaacacggtttaaag

SEQ ID NO: 326503 - DNA, 1284 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326504 - DNA, 1278 bp, Homo sapiens
  misc_feature (959)..(959): n is a, c, g, or t
  misc_feature (1055)..(1055): n is a, c, g, or t
  misc_feature (1150)..(1150): n is a, c, g, or t
  misc_feature (1211)..(1211): n is a, c, g, or t
  misc_feature (1230)..(1230): n is a, c, g, or t
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtggaaaaaaaaaaaaaaaaaaaaaataaaaaaacctccacgagggttcagctgtctcttacttttaaccagtgaaattgacctgcccgtgaagaggcgggcatgacacagcangacgagaagaccctatggagctttaatttattaatgcaaacagtacctaacaaacccacaggtcctaaactaccaaacctgcattactaagacttnaccagtcaaagcgaactactatactcaattgatccaataacttgaccaacggaacatgttaccctagggataacagcgcaatcctattctagagnccatatcaacaatagggtttacgaccttgatgtggatcaagacatcccgatggtgcagccngtattaaggtccgttcgtncaacgtttaaagccttacggatctgagttcagaccggggaaattcagg

SEQ ID NO: 326505 - DNA, 1059 bp, Homo sapiens
  misc_feature (854)..(855): n is a, c, g, or t
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtggaaaannacaaccacacaaacaaaaaacaaacaacacacaacataccacaacacaaccacacagatacacacaacaaaacacccgcgcggcaccaatatacgcggggggacaaaaaagaataaagcagcccacagacactctgctaccccccctgtgtaacaaggggagaaccggggcccaaaggaggaaaaaaaccacagcgtccaaaca

SEQ ID NO: 326506 - DNA, 1616 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagtgatttccaaaggcccttccagttccatttgtcagacatctcattgagcatattctgtgattcccctcccttgcaatgtaacccacagctgaggaattcctctacagattcttgccacagaaaatcatatacctgaatcagctcttgcaaagtgagtagtgtgggccccttctgccccatcctatgtcctctatcccctttgcccaccctctctagctaacaactggattcagcatgcagagaatagtttcaaatagtggattaggaacattaggatggcgtgaggcatgagcctaggttgggaggcagagtgcaagtgggatgtatggagggaaggctgtgacctaggatgaagggaagaggttgggcagcccttgacagtgagctctgtgcaggaggactccctcaatgtggctgacttgacttccctccgggccccactggacatccccatcccagaccctccacccaaggatgatgagatggaaacagataagcaggagaagaaagaaggtaagagagataagaggtgactagggaaggggtgatggcacactgactactggatgagaaagggcctgaatcccctctttctcacagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326507 - DNA, 1217 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgtgagtgtggagtaaggctttaggggaggtggatgagtgggggcaggcaggggattggctaagaacctgactcttgcactctggccttctcccagctgagctttatcatatcatcagcagcaacctggagaaaattgtcaacccaaagggtgaagaaaagccatctatgtactgaacccgggactagaaggaaaataaatgatctatatgttgtgtggaattcccttctggcgtgtgtcattcattcaaaaagcatttattgagtggcacctatgtccagcctgaagatgaatgtggtgggaaggggtgggtgtcacaaagacaaagatgacttagatgcccactgtaatcttgactgtgagaaagaggggattcaggccctttctcatccagtagtcaatgtgccatctccccttccctagtcacctcttatctcacttaccttctttcttctcctgcttatctgtttccatctaaggcaaaaagggggga

SEQ ID NO: 326508 - DNA, 1247 bp, Homo sapiens
aaaaaaaaaaaaaaaaaaaactggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtagtgagtggatagtccaccagccttttagctgggtgtgggacgaggaggtgtggaggaagaagtcctccttgtcttgtttgtgactttcccaatgtggagaatattaagctaaaagcattacctagaaaaactggtttgggcttcaacaaccttgacccttttctctgctcagtcctttgggatcctatttcttggtgctaagaaggggttcattctcaagttaacctatttcctataaaaggaaaccagactcatgtcccagcctcccatgggactgactcagctttgcctcccacattgcagatggattaccgggccttggtgcatgagcgagatgaggcagcctatggggagctcagggccatggtgctggacctgagggccttctatgtgagtgtggagtaaggctttaggggaggtggatgagtgggggcaggcaggggattggctaagaacctgactcttgcactctggccttctcccagctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 326509 - DNA, 2078 bp, Homo sapiens
  misc_feature (2)..(2): n is a, c, g, or t
  misc_feature (7)..(7): n is a, c, g, or t
  misc_feature (9)..(9): n is a, c, g, or t
  misc_feature (41)..(41): n is a, c, g, or t
tnacaantnttaatgaggcaatgttaaatatggacccaatntcagacaaatacatagaaaggagtaagggccaactctcatgcataaggtatcccatcctatagcaaatcagatatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcgttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctc

SEQ ID NO: 326510 - DNA, 2101 bp, Homo sapiens
  misc_feature (2)..(2): n is a, c, g, or t
  misc_feature (7)..(7): n is a, c, g, or t
  misc_feature (9)..(9): n is a, c, g, or t
  misc_feature (41)..(41): n is a, c, g, or t
tnacaantnttaatgaggcaatgttaaatatggacccaatntcagacaaatacatagaaaggagtaagggccaactctcatgcataaggtatcccatcctatagcaaatcagatatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcgttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 326511 - DNA, 938 bp, Homo sapiens
ttcttactctgatgttaatgaagtaacttgtcttttattatagaaatgcaccatgtcttggtacgtgctgctatttttctgtctttattaagtaaactaatgagtttcttctatttaaaacatgtaatgttttaaggcttccatctattgcaccaaatccccctacgggttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 326512 - DNA, 808 bp, Homo sapiens
cgcaggtgcatgctgaggtgatctagaggatcccacgggttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 326513 - DNA, 2028 bp, Homo sapiens
  misc_feature (2)..(2): n is a, c, g, or t
  misc_feature (7)..(7): n is a, c, g, or t
  misc_feature (9)..(9): n is a, c, g, or t
  misc_feature (41)..(41): n is a, c, g, or t
tnacaantnttaatgaggcaatgttaaatatggacccaatntcagacaaatacatagaaaggagtaagggccaactctcatgcataaggtatcccatcctatagcaaatcagatatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcgttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaggaatccccgtgggaccctctagactcactca

SEQ ID NO: 326514 - DNA, 803 bp, Homo sapiens
acgtgtgctctagaggtgtccccagggggatccgttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 326515 - DNA, 2967 bp, Homo sapiens
  misc_feature (2)..(2): n is a, c, g, or t
  misc_feature (7)..(7): n is a, c, g, or t
  misc_feature (9)..(9): n is a, c, g, or t
  misc_feature (41)..(41): n is a, c, g, or t
tnacaantnttaatgaggcaatgttaaatatggacccaatntcagacaaatacatagaaaggagtaagggccaactctcatgcataaggtatcccatcctatagcaaatcagatatataggtacgcttgatgccacaaattttttaaaaaattgtccattttgttgcgtgtgcacctcttgccataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggtaagatgttatttaaatcagtaaaaggctgactttggaatctttttcctttttcttttaagaaaaagtcaacgttaggattaaatatatattcaatagcaagtgcatgcaccagaaatttgctgcagtgtcagttgagggatattttttatacattcagtcactctgtaaatatacatattgttttcctttaaaatgggcactgaaatatacagaaaaaaatcactttataaaatgtgaggtttataggtactgtgttggtctggatttttcaagtgctttttacaaagatatatttatcctaaaaacatacagataaaatttcgaagactgctttaatatctaaataaaatctaccctatatacacacattgaattacattactgcagagattaaaaaaaaaagacacgacagccatttttctcatctgagtaagaaagcatatcatcaaaaatagtaatagcctacaactgcaactatttatttgcaaagaatgctattttatcatattaaggctctagaaagataaataagaaagaatatggttagaaaaggggggagggagagagaaaataaaggagaaaatgcaggagagagtagggagagagtctctctctaccacatagcccaatgaaggattaagcattgactataaatgaagggagctttgttagtttaatcactggaacaattataaaaggactcgacaacaacgaggtttattgaaaattttgcctaatgctaactgacccatgcagatgcctaaactgtatttgcatattaaaagaagggtgtatctgtttgtttctaggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcgttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataactgtgtcatttggctttccagtcataccaactttagcagaatcaaaatgacctcaccatttttgttctagggt

SEQ ID NO: 326516 - DNA, 2559 bp, Homo sapiens
tggccttatatgggcagccgcgtcacggacggcactcattcacataaaacgctgcgcggccggcggaatccccggcttctagggcggcgagcggccgcgctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacctgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagaatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaa

SEQ ID NO: 326517 - DNA, 2479 bp, Homo sapiens
tggccttatatgggcagccgcgtcacggacggcactcattcacataaaacgctgcgcggccggcggaatccccggcttctagggcggcgagcggccgcgctggctatcgagcgagcggggcgggaacgcggagttgcgccgccgctcgggcgccgggctccgtcgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacctgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagaatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaa

SEQ ID NO: 326518 - DNA, 2617 bp, Homo sapiens
tggccttatatgggcagccgcgtcacggacggcactcattcacataaaacgctgcgcggccggcggaatccccggcttctagggcggcgagcggccgcgctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagataactgaaaccagaggaaatcaaaagatactagagggcttcatgtttctgtaaactaggtggcccagttgaaatccttcccttcctctaccttggaagtgcctaccatgcatccaagtgcgagttcctcgccaacctgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagaatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaa

SEQ ID NO: 326519 - DNA, 811 bp, Homo sapiens
aaggatggtcctcagcttgctggtccttctggtgtgcttatgtctctggtgacaatggttttcctcccggccccgggaggtagtcttcaagctgaggaccatcgcttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaa

SEQ ID NO: 326520 - DNA, 639 bp, Homo sapiens
tggccttatatgggcagccgcgtcacggacggcactcattcacataaaacgctgcgcggccggcggaatccccggcttctagggcggcgagcggccgcgctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgtggaccagggcagccgccactggcagaagctgcgagaggagagcgccgcgcgtgtcgtcctcacctcgctactcgcttgcctacccgccggcccgcgggtctacttcctcaaaggtgagcgctcggggtccctgccacgctcgcccctccggcgcc

SEQ ID NO: 326521 - DNA, 508 bp, Homo sapiens
ggtgctacagagaaagtcctgtttgggtggctaagtaggctcctctaaggggttcttatgcttacaattccacagataactgaaaccagaggaaatcaaaagatactagagggcttcatgtttctgtaaactagtgagtttttgtttttcttctaaaaatgagtgctttgtgataactcattaaagggaaaaataaagtggaagggggttacgtagcaccatccaggaagatgaaaaagcaggtgagaatccaaatctggcagaagccagagatcaaaacctaaccattttacggaagggaaaagaagtgttctgtgacaagtgagatgattgattttgcagagtcctacagctggttcaaggcagcatcaggctcagaacccctttctctcagctccctgttgtgattatttcaggaccttgttctgttttccacatggcctctaatctagacacctgacctggtgggagtaacctttcaaacttttcacataaccaagaacatacc

SEQ ID NO: 326522 - DNA, 3137 bp, Homo sapiens
tggccttatatgggcagccgcgtcacggacggcactcattcacataaaacgctgcgcggccggcggaatccccggcttctagggcggcgagcggccgcgctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacctgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagaatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaaaaaaaaaaaaaaaaaaaaaaaaaaaaaaaaaaaaaaaaaaaaaaaaaaaaaaaaaaaaaaaagaccggaagaagccgaacacaaaaaaaaaacacccgaagcggcacgacaacacaacagcagacccccccacgttaacaacaaccggccgctaccacccagccctcgtcccgccacacatcaccgccacccgcccacttcacaaccgcgccgcaacgagcaacccgccgaccgacgcagcactccctacacaccacccacccctccggcacgggcgggccaccacacccccgaccaaggaccagaccaccgccagcacacctaccgaacacaccccccacacagaggaaaataccaaacagaactcgaccgaaagcagtgacagacccgaaacccccaccccaccacccccgcaacgcctgccacgacgcgacgcacccagccacacgcgccccccaccgcgcctccgccccacccgcacgcaccacacaccacagcagcagcccggaacccaacccccccgccccaccacccccccaagcccccacccacgcacccaccggcacaaaccaggcacg

SEQ ID NO: 326523 - DNA, 2477 bp, Homo sapiens
tggccttatatgggcagccgcgtcacggacggcactcattcacataaaacgctgcgcggccggcggaatccccggcttctagggcggcgagcggccgcgctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacctgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagaatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttttctgctattaatacttccactgtgttctgaaatccctgtggtgaatttttcatttccaggagttctgtttggttctttcctaaaatggctatgtcatctttcaa

SEQ ID NO: 326524 - DNA, 1236 bp, Homo sapiens
tggccttatatgggcagccgcgtcacggacggcactcattcacataaaacgctgcgcggccggcggaatccccggcttctagggcggcgagcggccgcgctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagataactgaaaccagaggaaatcaaaagatactagagggcttcatgtttctgtaaactagtgagtttttgtttttcttctaaaaatgagtgctttgtgataactcattaaagggaaaaataaagtggaagggggttacgtagcaccatccaggaagatgaaaaagcaggtgagaatccaaatctggcagaagccagagatcaaaacctaaccattttacggaagggaaaagaagtgttctgtgacaagtgagatgattgattttgcagagtcctacagctggttcaaggcagcatcaggctcagaacccctttctctcagctccctgttgtgattatttcaggaccttgttctgttttccacatggcctctaatctagacacctgacctggtgggagtaacctttcaaacttttcacataa

SEQ ID NO: 326525 - DNA, 300 bp, Homo sapiens
gaaaaggggaggacatctcaggaccccgatgccactctgtggcccagcttatccctcccaccaaggctgtggtgagggtctgacaggcagagctggggtggtccaggagagccacgcccccgcagcaagacctggcaaccctgcggcaccacccatcagccccggcctagcagccccgcagtaggatccagaggccccaagagtccctgctggcaaatgacctcagggagctaaaaacgagggatgacttcacccgggtggcaggtgcatgagtcagccagtgatcacaggaaagcccgg

SEQ ID NO: 326526 - DNA, 425 bp, Homo sapiens
catgcctggcctgtttgaatttttgtagcaattaaaaattgcgtaatttaaacacaaattgaaggggacagggactaaaaacataaatgagagttagaatgcagtgccacgttgaatgctttcacaggtaggagcctagaaatcatctgttccaactactgcacttttgagttgtggagaccagaccaagagaggtgaaatgactgttggctaaggcgtccacctctacttgcgtctggaattgcccctgcctctgcctttaagtctggtctgcgtggcttctgatagcgaagccaggggcggaccccgttcactgcatcaggagagccctgagcagcgcttggcaggaactctgcagcccagggcgccctctagaggctggaggaccttcgtcaagaccccggggggtgtggatgtggacctgg

SEQ ID NO: 326527 - DNA, 2232 bp, Homo sapiens
tggcacgaggcagaccatgaggtttaactgagtgaacaccgctgttccggggctctgcctctcgctgaacgctcctgctgggctggggcctcccgagtagctggaagtacagataatcacagctggcttatcaatattgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgccatcaccctcacccaagtgaatgtggtggtggctgatgaggccgaggccctggtgcttcaaggagcaccctttctgggggtctgcaggtcactgcagaggagcggtctgttacatcttcccatttggagaacctctctcaaccgtgctgtagctggttctgcagaaacaggaagtacaggatttcatgggctggctctgctcgcctcgactgagcttcacacctctggatgccacatgctctctcccaaacactgctttcagtgcaaggtagtgggcctaaggggtttggttgtcttttttttttttcatttttaaaattttaaatttttatttattattattttttagagacaaggcctcgctctgtcgcctaggctgaagcacagtggtgcgatcacagctcgctgcagccttgacctcctaggatcaagccatcctcctgcctcagcatccacagtagctgatgtgcaccaccagacccgtctcattttttctatttttattattttagagatggggatctcactgtgttggccaggctggtctcaaactcctgggctcaagcaatcctcccaccttggcctcaaagtattgagattacaggcatgagccactgcacccggcctttctcatttttatttttaaattgacagacgtaacagtgcgcatttatcacgcacaacacaatgctttgggaatggttaaatctagctcacaaatgcattacctcacacggttgtcatttttgtggtgaggcttggttgtatgttttgtttcattcatgtttttacatccttggagtctcctctgggtccgtcctttctttgctgtcatgctggcttgcctaaggcccaccgccacctgcgtacgagcattttaaactctagagtgagtgacagcctttttatggttggtgttactatttatttcctgcctctaaacttctcgtggtccttataaacttgtcaggatgtgtgttgcgttgaattctgcatgtcctttttttgcccaccctcaggttaagctggtactaacttatccccagaggaaacagggtttatgagcactgacagatgtcttccctgggcaaaaaaaaaaaaaaatagtatatgtatacacacacacatacacatttatatttatatttcttaaagcttttaatccctttcattccctgatatctcagagatttcaaatcattgaacactgaagtatatttttcaggccagatgaaaaattgtattaaaaccctattcctggtcaggcgcagtggctcacgcctataatcccagcactttgggaggccgaagtaagcagatcacctgaggtcgggagttcaagacaaacctggccaacatggtgaaaccctgtctctactaaaactacaaaaaaattagcctgatgtggtgttgtgtgcctgtagtcccagctacttaggaggctgaggtaggagaattgcttgaacctgggaggcggaggttgcagtgagccaaaattacgccactgcactccagcctgggcaacagagcgagacagtctcaaaaacaacaacaacaacaaaaaccctattccttgcctttgtaggagtcaaaataaatgaacttcttttttcttttttttattattatactttaagttctggggtacacgtgcagaatgtgcaggtttgttacataggtatgcacgtgccatggtggtttgctgcacccatcaacctgtcacctacattaggtatttcccctaatgttatccctcccctagccctccatcccctgacaggccctggtgtgtgatgttcccctccctatgtccatgtgttctcattgctccaaaataaatgaatttacacaaa

SEQ ID NO: 326528 - DNA, 1931 bp, Homo sapiens
atctggcacaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctatttatgcaaatctgcatgtttcttttgttatttcctttaccatacattattgcaaattaataaatatacctcactagcaaaaaaaa

SEQ ID NO: 326529 - DNA, 2024 bp, Homo sapiens
atctggcacaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagatagggtttcaccatattgcccatgctggtcttgaactcctggactcaagcgatccacccactttggactcccaaagtgctgggattacagagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctatttatgcaaatctgcatgtttcttttgttatttcctttaccatacattattgcaaattaataaatatacctcactagcaaaaaaaa

SEQ ID NO: 326530 - DNA, 2093 bp, Homo sapiens
gacaggtttttgtcttgtatcattgtttcactgaatcttggtctctttattaaaatcttgtatatgaaataacagtactttgctctgatttactataaaacattattttagtgctcttctcagaaggaagaaccaaaaatctgtcccaggacttgcatattatggtgatggtgaagggcactctgatcagatctaaatctagtgtaggttgctttcctttatgatctgcttgctgctgtttttctggggcagtgactttagagctcctattgaagaggaagaaagagatccttggccatttttgtttctttcatcatgtggttttcattgtgagaaataatttgtttgggttttgtttttaattaccagagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctatttatgcaaatctgcatgtttcttttgttatttcctttaccatacattattgcaaattaataaatatacctcactagcaaaaaaaa

SEQ ID NO: 326531 - DNA, 1893 bp, Homo sapiens
atctggcacaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggagagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctatttatgcaaatctgcatgtttcttttgttatttcctttaccatacattattgcaaattaataaatatacctcactagcaaaaaaaa

SEQ ID NO: 326532 - DNA, 1849 bp, Homo sapiens
atctggcacaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctattta

SEQ ID NO: 326533 - DNA, 1260 bp, Homo sapiens
taagatggagtcacgttctgtcgcccaggctggagtgcagtggcacgatctcggctcactgcaacatctgcctcctggtttcaagcaattatcctgcctcaccctcccgagtagctgggactacagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctatttatgcaaatctgcatgtttcttttgttatttcctttaccatacattattgcaaattaataaatatacctcactagcaaaaaaaa

SEQ ID NO: 326534 - DNA, 3091 bp, Homo sapiens
  misc_feature (3078)..(3078): n is a, c, g, or t
atctggcacaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagatagggtttcaccatattgcccatgctggtcttgaactcctggactcaagcgatccacccactttggactcccaaagtgctgggattacagagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagccaggtcatgctgatgcaagaggtgggctcccatggccttgaacagctctgttcctgtggttttgccggaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaagtaagttgtgcatttgttttctctttccacattatgttttagcttttgttgtcatgttggtgttaagaaattaatgaattaaatgccactataccatttccctacttgaagcttctaggagccaatactgctaaatattatatgtttaaaataggttgaattattacagatgattcatgttaatatgcagaaagcttgcttttaccaaaaattattgtttttttcttgtaatctaagctgtctgtacatatggctgcagtgctaaatcagacttcaacagtgatgaatatttaccaataagcactttccaggcatcaggatacaataatgaacaaaccccagcccctacctcttagcattgttgttctaatagggggaaggcagaccataaacaaaacagattcttacgtctcttactatgtgtcaggcactcatctaagaactcgtagctcatttaagcctaacaacaacctgtgtggtatgtaccattatcatccccactttaaagataagcacactaagacactggtagtaaatcactctagtgaaaaatgaagcaaggtaaggtagttggcgaggggtaggatgggagtaggatgtcattttatattgcaaagtcagggaagattctttagataaggtgatatttaagcaggtaacttgaaggaagtgaagtggtgagccatatctgatggaagatcattcccagaaaaggaaacagcaggttattttaattgtaacagaatcaaagtttgtacttgtcctgtactcttagatgggtttgatcaaatttatcctaagaacggaagggtcttagtctttttctggaaagtaaataagacattgaaaaaattaattaggtttcttatgcaagtagtaccagtcataaaatattcaaacactaagagatatatacaaggtaaaattatatcccgctccagaagtaaaacgtttgttgtctactcttccacttccttttctgttcattttgcacctaaacatgtgtattttttacacttaaaaaaagcccatgtcttagagattctttccattgtgagtgcttgacattttatgaaatggaggtactataaattatttagccagttttcttttaatggatatttggtttattacttttttgctgttataattagtgttgtgatcttgtatgtttgttttctgattataagttttttatattagaggaatttctagaggtacaattgttgagtcaaagggtatggacatttaaaattttgagaggtaatatcaaagtattttgtaaaaaggcatcatgaatttatattcccacctgaagtttttataaatgtccattaccctgcactctcacccaaatttccatttagatttttgcctatctgatgtgattctaaaggaaacaggtttacttgacactatccttatattttattgagacatgttcaatggatgcatctcagttttatgcttttgagactctttttgagggcttgggtttttttttgtgtgtgtgcccttatgcatagtcaactagtaagctgtacattgattatattctcttttgatgtatgtgtttgtgtgtatctttatatatttaggtttatatcatcaaatttattaaaaccctttatattcatcttttctgtttattaaaatgtggacttttgtgacaggtatgttgaatcttatattatgattatgtaagtaattttcttctgttttgatactagttttcacattatgtattttaaagctgtgttattagaggaataaaantttgtggcatgac

SEQ ID NO: 326535 - DNA, 1103 bp, Homo sapiens
atctggcacaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagatagggtttcaccatattgcccatgctggtcttgaactcctggactcaagcgatccacccactttggactcccaaagtgctgggattacagagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcaggtaagaatttcataacaagaagccaaaatgattggcttcttgcttaaaagccagaatgatattttatagtaaatatataggaaagatagatgattaatatatgttgtggaattggtgcttttcaaaatagaccccaagtaacataccatccaatataccaagaagtttgtatattttgaccttcataaatacagagtattgaattttaagtat

SEQ ID NO: 326536 - DNA, 613 bp, Homo sapiens
accgcaatcttaaatttttgaaaaacaatcctcacacaaagatactatcaacaaatcacacaccaatttatcttagaaggatcaagagatgaaaaacagcaaaggatattttcgtaatatgctagaatctttgaatataatactgaagttggcaaccaaaagcaattcagaagttcaacttagaactaatggctgtatccgatggcactgtctattttagatattaaaatgtcaccatcttggtattttcacatggctataggcattataaactggaacactactgcgggtttatctggcactctgtatccaaaagtcccccaaaagtacatactctttgactctgtaattctgcttctaggcatgttaagaaaaatacgtcaggtatgccaaaatgtatacatgaaagggtgttcaccaataacattatttaaaatagttcactactggccaggcgcagtagctcatgcctataatcctagcactttgggaggccaagttgggggcaaatcacctgaggtcaggagttcgagaccagcctggactacatggtgaaaccccatctctactaaaagaacaaaaattagccaggtgtggtggcagatgcctgtaa

SEQ ID NO: 326537 - DNA, 939 bp, Homo sapiens
aaaaaaaaaaaaaaagaaagttatatgatcttgaatataaaaagtatggtctctaaagaatttgttgttgtttttacataatgtaggaggaaaaaaattgtggtgtttataagcatcagcctgattaccaaaaatactttttgtggtagactggattttgagaatgttaaaacaatcttcaaaaattgaatattaaatccaaaaataagcaagccacagctaaatgaaaaagtcatagtacataggtgtaatacactttactcaaggggtgtaattccaaaaaaaaagtttttaaaaaaggtaatttgtctcctactggatatactaaataccttagtgaattttttattttgaatagctctttgttaatctacataattgtttatgaatttaacttgctttataagttcaaattatcctatatgctatacaacacactaatggtaatgatgaataagatctactaattaggctttcttctgggcaatgcatgtgggtatcttagattgcttagttaaaacataatgagtaaagatgtccttagatcaggccaaacacttcatcttccccctgcacctccgtttgattaaatttttcgtaaattttgttagggctgcatggcttattgggaagggacctcatccctaccccaggcattggtatcaattttcctgaagctatgtgaagtattaaaaaaccatattcaggcctggcatgttggctcacgcctgtaatctgagcatttagagagacagaggcgggctgatcagttgaggtcaggagtttgagaccagccaggttaacacggtgaaacgcctttactaaaaatacaaaaattagctaggcgtggcggcccatacctgtaattccagctactcagaaggctgaggcaggggaatcgcttgaaaccaggaggcagaggttgcagtgagcccagat

SEQ ID NO: 326538 - DNA, 886 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaatta

SEQ ID NO: 326539 - DNA, 815 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaatta

SEQ ID NO: 326540 - DNA, 810 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcataccccactctcctgatactccccttccgcccacccctacccacccctctccgccccctcgccacgccccccgcctggcctcccccagcctccctcctctgcgtccgccccccccgcctccattcacgctctcctaccctccctctcctcctcccacctccgccccccgctcctccctctcgccccccccggcgcctcctccttcccccttcccccccccccctcctcgccccttccccaccctctcccgctccc

SEQ ID NO: 326541 - DNA, 516 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcataaaaaaaaaaaagtcgacgcgggccgcgaat

SEQ ID NO: 326542 - DNA, 678 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggttgccatccaaatagcaatgcctggtgggttgaagcagtggaagtatttgagaacagtaaaagaccttgaagaggatgtatttttattttatttttaattcataaagccatctttccactgccacaactaagctcccctcctgaactcaccagtagaagatggaaaaggcagttgcctgcttctatttctttgtaccacagtcattgtttacctctgtggccctctctagtgactgtctaaacctaagaaacacaaactgccttgactgatcaatttccagacagctagcaaactt

SEQ ID NO: 326543 - DNA, 395 bp, Homo sapiens
caatggctagattggttgaaaactcaagtatttgtttagcctcacacattttctctttttgactctttacttttttccttcttcttttcctgtaaaaggttgccatccaaatagcaatgcctggtgggttgaagcagtggaagtatttgagaacagtaaaagaccttgaagaggatgtatttttattttatttttaattcataaagccatctttccactgccacaactaagctcccctcctgaactcaccagtagaagatggaaaaggcagttgcctgcttctatttctttgtaccacagtcattgtttacctctgtggccctctctagtgactgtctaaacctaagaaacacaaactgccttgactgatcaatttccagacagctagcaaactt

SEQ ID NO: 326544 - DNA, 3617 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggactttagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaataaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgaggggaggggtgagggatagcattaggagatatacctgatgctaaatgacgagttagtgggtgcagcacaccagcatggcacatgtatacgtatgtaactaacctgcacatcgtgcacatgtaccctaaaacttaaagtataataataataaaataaaaaaaaaaggaattaggcaaaacat

SEQ ID NO: 326545 - DNA, 3562 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggactttagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaataaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgaggggaggggtgagggatagcattaggagatatacctgatgctaaatgacgagttagtgggtgcagcacaccagcatggcacatgtatacgtatgtaactaacctgcacatcgtgcacatgtaccctaaaacttaaagtataataataataaaataaaaaaaaaaggaattaggcaaaacat

SEQ ID NO: 326546 - DNA, 3529 bp, Homo sapiens
accaattgtgactcttctatatctaccggcctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggactttagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaataaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgaggggaggggtgagggatagcattaggagatatacctgatgctaaatgacgagttagtgggtgcagcacaccagcatggcacatgtatacgtatgtaactaacctgcacatcgtgcacatgtaccctaaaacttaaagtataataataataaaataaaaaaaaaaggaattaggcaaaacat

SEQ ID NO: 326547 - DNA, 3546 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggactttagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaataaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgaggggaggggtgagggatagcattaggagatatacctgatgctaaatgacgagttagtgggtgcagcacaccagcatggcacatgtatacgtatgtaactaacctgcacatcgtgcacatgtaccctaaaacttaaagtataataataataaaataaaaaaaaaaggaattaggcaaaacat

SEQ ID NO: 326548 - DNA, 601 bp, Homo sapiens
  misc_feature (572)..(572): n is a, c, g, or t
accaattgtgactcttctatatctaccggcctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcataaaaaaaaaaaaaaaaaactcgagttttttttttttttttttgaccaaaggtatattaatatattgattctttgaaaatgagaattgagacatgggctaaaattaaatacatcaacaacaaaaatcttgtaaggagaagttaaaagcagttatttcaaggataagggatatttgnttcattttgaacctgatatacattacttt

SEQ ID NO: 326549 - DNA, 836 bp, Homo sapiens
accaattgtgactcttctatatctaccggcctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgacaaaatcaaagggacccttaggaggagagtgtgtcattttctaggggaaaaaagaagttttcagtgcctcagctcttgccaggctgaagagacaaagttgtgtttatcttgaaaagtctttcagtgcgtggtgccacttgtcctggagaacacaccagcctctgcccctgcactgtaccatctcctatattatatcccccacctccacctcatcccccagcccccaagtcatgaggctcagtcgttgctgggagaatggtgaagaggagtcacagaacaggtggataaacttagtggatgaactgcacctaccttcctctcagacagagatttggtccccaagacttttcagagcgggtttgtgctggtcaccttcccacagaaggaagtgtgtggaggaagttgaagctgctgtggttccagacgcaggcaggtcacccctgatgctttcaacaagaggcgtgcagtgcatcgcaggacatctgctaagggccatctcagaggcccacccctggaagccacagaaaccgaaaagacccaagcacccgccaactcaacaagttactcttttaaaaatgccttgatttcttcatcagtaaaactagcaatggg

SEQ ID NO: 326550 - DNA, 1050 bp, Homo sapiens
accaattgtgactcttctatatctaccggcctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgtaagtagactttattttttaacctgagtgtgttagcaggtgtcagcttttggaagtcgatatgttacacaaaatattctgaggcctatttcaatattgtattgcgcacataattactagttaggtctttaagaggaaaatgtcattaacacctcatttatctgggatatcaaatagtctatgtaaatgacttttgcagataactaaagcttacgattcaggaactgaattttttttgtttatcaaattatttttcacggacatatttttaacttagggtcatccatgtgagttttcacttttctgctacagtataataccatgatatcctccaacagctattaaagtgtttagggctgcttgtccctatactaaatgacttcaggaatgcagtgtttttttcagtcttgtttctgctcagaatgtctagctttttttttcttctccaatctcactgtcagtctgttgttccttacttttgctgctaaataataagctgccttcctatccttcttctcgtcctcaatactgggaaaccaaataaactatgtataaaaaaatcaattctgaggttagcactaaggatttctgtaagttaagtatatgtatacttcagtgcccaatattgtgagaagtatttaactgttcacattccctttttgcttgtctcctggttcttgggtaccttctaaacacatgaggaataaatgtacaggtaatggtattttgtcagaggagtttgaaagacagcaggcctttagaatggagtcagataataataaatgttctaagctagaagaatctttttctttctttttagcatatgtt

SEQ ID NO: 326551 - DNA, 812 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcataaaaaaaaaaaaaaaaacaaaaaaaaaaaactttttgggcgcgccttgggcccctgaaaaaaagagttttttctaaacccactttcgcttgggggcccgcgcgggggccccccagtgagttatatgtgaacccgtggggccaaaaccgtgttcccggaggaagacaccggggtccaggaaccatcggtgtggggttttttctccccattttaaaaaagcgccggggggcagcccgcgcggtttgtgatccatttcg

SEQ ID NO: 326552 - DNA, 780 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcataaaaaaaaaaaaaaaaaaaaaaaaaaaaaaaaaacaaaaaaaaaaaaaaaaaaaaaaaaaccacacacacaacaaaatggaacggaaaaaacaaacaccccaaaaaaaaaaaaaaattttgggccctttgggccaaatgctttttacatttaaaacactttttttcttggggcccaattttgggctcctttggggcaattggcccttatattggggccgttttt

SEQ ID NO: 326553 - DNA, 1192 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcgtaagtagactttattttttaacctgagtgtgttagcaggtgtcagcttttggaagtcgatatgttacacaaaatattctgaggcctatttcaatattgtattgcgcacataattactagttaggtctttaagaggaaaatgtcattaacacctcatttatctgggatatcaaatagtctatgtaaatgacttttgcagataactaaagcttacgattcaggaactgaattttttttgtttatcaaattatttttcacggacatatttttaaaagctttatgctgccttaacaagatatactttttattattgttattattgtgaccttagggtcatccatgtgagttttcacttttctgctacagtataataccatgatatcctccaacagctattaaagtgtttagggctgcttgtccctatactaaatgacttcaggaatgcagtgtttttttcagtcttgtttctgctcagaatgtctagctttttttttcttctccaatctcactgtcagtctgttgttccttacttttgctgctaaataataagctgccttcctatccttcttctcgtcctcaatactgggaaaccaaataaactatgtataaaaaaatcaattctgaggttagcactaaggatttctgtaagttaagtatatgtatacttcagtgcccaatattgtgagaagtatttaactgttcacattccctttttgcttgtctcctggttcttgggtaccttctaaacacatgaggaataaatgtacaggtaatggtattttgtcagaggagtttgaaagacagcaggcctttagaatggagtcagataataataaatgttctaagctagaagaatctttttctttctttttagcatatgtt

SEQ ID NO: 326554 - DNA, 3446 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggactttagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaataaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccaaaagaaaaaacagaaagaaacaaagttgtgggcggccgggcccccaaaaagttttaaaacccttcggtgggcgggggccccgaggatatggactggccagcgggcccagggaaacccggccggccggtggggtctcccaaaaaaacgccggggaccggggttgacacacccagggtccggggccgggcatcacgggcaagggcgataag

SEQ ID NO: 326555 - DNA, 2448 bp, Homo sapiens
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaatttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgaggggaggggtgagggatagcattaggagatatacctgatgctaaatgacgagttagtgggtgcagcacaccagcatggcacatgtatacgtatgtaactaacctgcacatcgtgcacatgtaccctaaaacttaaagtataataataataaaataaaaaaaaaaggaattaggcaaaacat

SEQ ID NO: 326556 - DNA, 644 bp, Homo sapiens
  misc_feature (528)..(528): n is a, c, g, or t
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataaccatctcaacgggccgccttccgctccgncttctcgtccttacgaattaccccccgcgtcgagcacactactatcccgagcccgccctacgctcccccgccacttcccaccctctcacccatcccccacaccctcgctccgcccg

SEQ ID NO: 326557 - DNA, 878 bp, Homo sapiens
tttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagccagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 326558 - DNA, 1162 bp, Homo sapiens
cgggcttcgccccacccggcccgtggggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 326559 - DNA, 721 bp, Homo sapiens
caaaatgacgaacacaaagggaaagaggagaggcacccgatatatgttctctaggccttttagaaaacatggagttgttcctttggccacatatatgcgaatctataagaaaggtgatattgtagacatcaagcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 326560 - DNA, 1331 bp, Homo sapiens
  misc_feature (1331)..(1331): n is a, c, g, or t
tttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagccagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaaaaaaaacaataaaaatcccacgaacacacacacaaaaccagggggggagcagccacagaaaaaccacggtggggggccaaagataccgcgacccatattctgtggacacagtggccacaaacagacacacaataaaacaacaagcgcacgcagtaaaaaagcacgaaggcaaaagggcagcggacactcggaggaggccccacccgggcggcaacacgcgcacaccaccaaaagaaacgctagagacataaaaaccacggcagcgggcaacccaccagaataaatccggtgcaaagatggccacgggcgctgttacaattgccagcgcaaaagagaacgaccaaaagacgagccaatacaagctcagcagctacataggtagcgagtactctagggcagccgcgacaccagaccaccatgaacttctctacgtaccgctcctgtggcgtcatn

SEQ ID NO: 326561 - DNA, 797 bp, Homo sapiens
tttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagccagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttc

SEQ ID NO: 326562 - DNA, 1254 bp, Homo sapiens
cgggcttcgccccacccggcccgtggggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatggtcagctggcaggctctttgggaccttgtattgggatccgccgtgaagctgatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcc

SEQ ID NO: 326563 - DNA, 1234 bp, Homo sapiens
cgggcttcgccccacccggcccgtggggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaacaaaaaaaacgacagcacacaacaaaaacaaacaggagaacaaacgacaaagccgaccacacaccacactca

SEQ ID NO: 326564 - DNA, 747 bp, Homo sapiens
agctcggtacccaattacttgcgcacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 326565 - DNA, 619 bp, Homo sapiens
aagccatcgcatgattaaacaaagaatccgccagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 326566 - DNA, 495 bp, Homo sapiens
gcggccgcctactactactaaattggcggccgtacgacgctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 326567 - DNA, 1081 bp, Homo sapiens
cgggcttcgccccacccggcccgtggggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttc

SEQ ID NO: 326568 - DNA, 1615 bp, Homo sapiens
  misc_feature (1615)..(1615): n is a, c, g, or t
cgggcttcgccccacccggcccgtggggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaaaaaaaacaataaaaatcccacgaacacacacacaaaaccagggggggagcagccacagaaaaaccacggtggggggccaaagataccgcgacccatattctgtggacacagtggccacaaacagacacacaataaaacaacaagcgcacgcagtaaaaaagcacgaaggcaaaagggcagcggacactcggaggaggccccacccgggcggcaacacgcgcacaccaccaaaagaaacgctagagacataaaaaccacggcagcgggcaacccaccagaataaatccggtgcaaagatggccacgggcgctgttacaattgccagcgcaaaagagaacgaccaaaagacgagccaatacaagctcagcagctacataggtagcgagtactctagggcagccgcgacaccagaccaccatgaacttctctacgtaccgctcctgtggcgtcatn

SEQ ID NO: 326569 - DNA, 1691 bp, Homo sapiens
gacagaagactgaggctgcaggtccgatgtgtcccatgggctgtgtcccctcttcctactgtcagtttctgaaacttctgactggcctcccagttatgcctcctcctcaagttcctggcccgtggatgttaaagctgctcgattcccaggatctcggctgccttttcctctatcctgagctccctctgccctgccagttgtcagtcaggcagggagggagtggctgtgttggtttggggaactaatttccaaggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtga

SEQ ID NO: 326570 - DNA, 4145 bp, Homo sapiens
aactctcacattcctggcatagcagccgcctccggcgcgggccgaccctggggctgcgcgctggggcgcgaacagccagagcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagcagacagagcacccacagaggagccagtggtcacagctccccctgctgcccatgccaaacacgggagcagagatgggagcacccagactgacggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccaaggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagca

SEQ ID NO: 326571 - DNA, 4947 bp, Homo sapiens
aactctcacattcctggcatagcagccgcctccggcgcgggccgaccctggggctgcgcgctggggcgcgaacagccagagcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagcagacagagcacccacagaggagccagtggtcacagctccccctgctgcccatgccaaacacgggagcagagatgggagcacccagactgacggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccaaggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtgatgtctttgcacaggtgagactttgcactgagggaagggaaagggtgaggattttggggggccacccaagtcatagtccaatctcttcaaggacccaagatagaatttaggaattttgtgaagctgcattaaggatagagttggaatgaggatgtggctggcatttttcccctttcatagataacatttcttgaaggctgggaggggaaggagggcctggcagatggcagcctcccgaggtagggctgtgttctaatcagctttgttcggccacacgctgtggttatccacagtgggagtgggtgtccaaagatggctttatccttcccccactccttttcccactcccacctagcacataaagttttgtccgaaaccatccagaaggccaggcaccatgcagaggacattcaagaatgtgcatgttcttagccaccgcctccctcctttgctgtgacatcaccactctttcctgatgctcaggaaagcatattgctccaattcaaaattaaagaaagccattctcagt

SEQ ID NO: 326572 - DNA, 3716 bp, Homo sapiens
aactctcacattcctggcatagcagccgcctccggcgcgggccgaccctggggctgcgcgctggggcgcgaacagccagagcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagcagacagagcacccacagaggagccagtggtcacagctccccctgctgcccatgccaaacacgggagcagagatgggagcacccagactgacggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccaaggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtga

SEQ ID NO: 326573 - DNA, 2403 bp, Homo sapiens
cactttagctcctctttcatggtcttccctacatagttaatttccaatttgattatccaagagaatggagctcgcaagtcatgccgatggcactctggaagcctgtttaaagagtccgggaaggagaaatctgagaagatgccatttctttttccactcccctttcacattggcctttgcatatttgcctgtgcctcatgatctcagaaaaccacaggcatgaaaagaatgctgcagcctgcctccctcagggctctccattgctctctctaagccctccaaccagttcaaagttagaaacaaatgcatcctacacatcggaggttggtgggctgggctgagcactgaaagggggcagagcattgtgcttggttggccgagttctgggaacctgggcagcagaggtgggaaaagttggtgaagaacgatctttgtctttcaaatgtgccaggattttaaaagcaatctagtaacactcattggcatgtgcctgtgttcttgtctgtctccagactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccaaggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtga

SEQ ID NO: 326574 - DNA, 1374 bp, Homo sapiens
gggtgactctagagtcccccccgactagcccgacaggttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtga

SEQ ID NO: 326575 - DNA, 1320 bp, Homo sapiens
tggtcggccctcattacatggaggatgtgtgtgtgtgtgtgtgtgtgtagccaagtgtgcagtggtatgttctggaacgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtga

SEQ ID NO: 326576 - DNA, 952 bp, Homo sapiens
tgctacatcccccaatctgatctacaattgcatattaatgatcaacttaaatgtggtttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtgatgtctttgcacaggtgagactttgcactgagggaagggaaagggtgaggattttggggggccacccaagtcatagtccaatctcttcaaggacccaagatagaatttaggaattttgtgaagctgcattaaggatagagttggaatgaggatgtggctggcatttttcccctttcatagataacatttcttgaaggctgggaggggaaggagggcctggcagatggcagcctcccgaggtagggctgtgttctaatcagctttgttcggccacacgctgtggttatccacagtgggagtgggtgtccaaagatggctttatccttcccccactccttttcccactcccacctagcacataaagttttgtccgaaaccatccagaaggccaggcaccatgcagaggacattcaagaatgtgcatgttcttagccaccgcctccctcctttgctgtgacatcaccactctttcctgatgctcaggaaagcatattgctccaattcaaaattaaagaaagccattctcagt

SEQ ID NO: 326577 - DNA, 4419 bp, Homo sapiens
aactctcacattcctggcatagcagccgcctccggcgcgggccgaccctggggctgcgcgctggggcgcgaacagccagagcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagcagacagagcacccacagaggagccagtggtcacagctccccctgctgcccatgccaaacacgggagcagagatgggagcacccagactgacggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccaaggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtga

SEQ ID NO: 326578 - DNA, 4621 bp, Homo sapiens
  misc_feature (4436)..(4437): n is a, c, g, or t
  misc_feature (4447)..(4447): n is a, c, g, or t
  misc_feature (4451)..(4451): n is a, c, g, or t
  misc_feature (4456)..(4456): n is a, c, g, or t
  misc_feature (4459)..(4459): n is a, c, g, or t
  misc_feature (4463)..(4463): n is a, c, g, or t
  misc_feature (4465)..(4465): n is a, c, g, or t
  misc_feature (4467)..(4467): n is a, c, g, or t
  misc_feature (4476)..(4476): n is a, c, g, or t
  misc_feature (4478)..(4478): n is a, c, g, or t
  misc_feature (4482)..(4482): n is a, c, g, or t
aactctcacattcctggcatagcagccgcctccggcgcgggccgaccctggggctgcgcgctggggcgcgaacagccagagcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagcagacagagcacccacagaggagccagtggtcacagctccccctgctgcccatgccaaacacgggagcagagatgggagcacccagactgacggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccaaggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctctctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcaggaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtgaaaaaaaaaaaacaaaannaaaaaacaanaaanaaaanaanaaanananaaaaacaananaaanagaagcgagacaacaacaagaacaacaacaacaaagacagaagagaaacaggagagcggaacgccgagatacagcggacatccacccgaggagaagagcggacgaggcggaggggccgagcgcccccccactcccaggg

SEQ ID NO: 326579 - DNA, 2776 bp, Homo sapiens
aactctcacattcctggcatagcagccgcctccggcgcgggccgaccctggggctgcgcgctggggcgcgaacagccagagcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagcagacagagcacccacagaggagccagtggtcacagctccccctgctgcccatgccaaacacgggagcagagatgggagcacccagactgacggccccccagacagcacctccacctgcctgccaccggagcctgacagccttctggggtgcagcagtagccagagagcagcctctctgggtaagtcctcctgaccccacttctgtgctaggtagggccgagggggcactggggtgtgaactggaacacaaggccttttcttcccagaccccctccgggtcattgcccgcactccatggggagccgtgcatagccagaggtgagcagggtgcctggcccacctcaatgtgaacatgagggatggctggttgcatgaatagggaaattggaaaccctgattagaggcagatccagaattcagaaagaaa

SEQ ID NO: 326580 - DNA, 1074 bp, Homo sapiens
actgctttcttgacatctgctagtttgacacgtggcaccggattccatgtgcagctggtaccttggatttgaatgttcttctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagactcctacaactcttccaagagcagctggtcgagaaaccaaatatgcaaatctctcctcaccaacttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatag

SEQ ID NO: 326581 - DNA, 754 bp, Homo sapiens
attcagtttacctccttgttagatgatgcattttagggaatggtgcagtcaatgctaaagtgaagttaagtcatcagccaagtcatggaagggtgtgggtgtgggtgagatataacagtgctgttccttaaggcagcccctgcccctcaaaaccatcatggcactttgtaggaggccagaactgctctgctgaactgccaagagattggagtctgatgtaaaggtacagctgtttgtctttattatgccattaatagtgaaacaaggaaggatctacttaaggaataaaaataagcttttcctattgtagtataaaccatttttttgtaggagatgctatgcccaaatattaatgtataattttcaggtgtatatttttaaatttattcatcttaacctgactaccatattctcttattttacagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatag

SEQ ID NO: 326582 - DNA, 1416 bp, Homo sapiens
ggcataatttgtacagtgctttgtcatctttgcagctcatcaatatcagcagctgacacaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagactcctacaactcttccaagagcagctggtcgagaaaccaaatatgcaaatctctcctcaccaacttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatag

SEQ ID NO: 326583 - DNA, 2084 bp, Homo sapiens
ggcataatttgtacagtgctttgtcatctttgcagctcatcaatatcagcagctgacacaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccaacttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaatagaagagatttacctacagctttttgcaccactgttctagcctttaatgccttctacttaatattaagctgaccgcaatactaacgtgcccctatatttggcagccaaataaagaagaatcgtgggtaaatagaagaatggctgtgactatttttcaatacaaattttatttaatgcatacatttctaactgagtcaggtttttattccccttttacttcacttttttacatgaaaaaaatcacaacttttaaagtaactaattagctttcagaagacgctgatattcagaggttctctggtgagatcttgaacatgagaaagttggtattttgtataacacacattgctttcctgttctgttgggattcggtgctgctgggacagactatgtgccaggagcagcccagtgctgatgaacatcgcgttactggagtgtctgtgtctgggataccactgtctctctgcctgtcaccacatgattcttgtgaagactactttagagttagtttgtatccaaaatcctgagagcagcagagaccatagagcaaacccatacttgatgacagtcctg

SEQ ID NO: 326584 - DNA, 862 bp, Homo sapiens
  misc_feature (847)..(848): n is a, c, g, or t
ggcataatttgtacagtgctttgtcatctttgcagctcatcaatatcagcagctgacacaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagactcctacaactcttccaagagcagctggtcgagaaaccaaatatgcaaatctctcctcaccaacttctacagtatctgagagtcagctgactaagccnngagtatttccccag

SEQ ID NO: 326585 - DNA, 789 bp, Homo sapiens
ggcataatttgtacagtgctttgtcatctttgcagctcatcaatatcagcagctgacacaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaagactcctacaactcttccaagagcagctggtcgagaaaccaaatatgcaaatctctcctcaccaacttctacagtatctgagagtcagctggtatgtatcttctaagt

SEQ ID NO: 326586 - DNA, 1698 bp, Homo sapiens
ggcataatttgtacagtgctttgtcatctttgcagctcatcaatatcagcagctgacacaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccaacttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatag

SEQ ID NO: 326587 - DNA, 2138 bp, Homo sapiens
ggcataatttgtacagtgctttgtcatctttgcagctcatcaatatcagcagctgacacaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccaacttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaagaatggctgtgactatttttcaatacaaattttatttaatgcatacatttctaactgagtcaggtttttattccccttttacttcacttttttacatgaaaaaaatcacaacttttaaagtaactaattagctttcagaagacgctgatattcagaggttctctggtgagatcttgaacatgagaaagttggtattttgtataacacacattgctttcctgttctgttgggattcggtgctgctgggacagactatgtgccaggagcagcccagtgctgatgaacatcgcgttactggagtgtctgtgtctgggataccactgtctctctgcctgtcaccacatgattcttgtgaagactactttagagttagtttgtatccaaaatcctgagagcagcagagaccatagagcaaacccatacttgatgacagtcctg

SEQ ID NO: 326588 - DNA, 1165 bp, Homo sapiens
ggcataatttgtacagtgctttgtcatctttgcagctcatcaatatcagcagctgacacaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctatccggcccaagtctctagctatctcgtccagtctggtctctgatgtagtgcgtcccaaaacacaggggactgatctcaagacctcatcacatcctgaaatgcttcatgggatggcccctcagcaaaagcatgggcagttaacttcttctcccactacctctgagcagcttgcctgtaaaccacctgctttctcctttgtttctccaactaatccgaacacaccacccgacccagttaacctcgagggagcctctgtcctagaggagttccacactaggaggctggatgtcggtggggccgtggtggaagaatcagctacgtattttcaaactaccgctcactctacacccttttctgcatcgaagggcacctcctcgacgttactgtttccccattccactcaactatcaggttctaatttacccagttcaactgcagcagatccaaagcctggactgacctctgaagttctcaagaagacaactttaacctcgcatgtccttagtcacggagaaagtccgagaacctcttcttctccaccgtcctccagtgcttctctgaagtcgaattcggcctcgtacataccagtccgcattgtcacgcattcactctctccgagccccaaaccatttacctcctctttccacggctcttcttccaccatctgcagccaaatgtcatctagtggaaat

SEQ ID NO: 326589 - DNA, 1578 bp, Homo sapiens
atccttcgcgtactgacggaaacactggcggcacatattgaggccgtatttcaggatcagctgccggttcgaacacacgcgagaagagcaaagaagttaaaagagaagtgtctgtgtggctccttccacgtgggtgaaggactgtgccagctgagaggtggtagagcaggaagctgcctgagacctccatttatttggtgaaaaaccgccgcccttaagagagcaagtcgagggccgtgtaggagttggaggagagaaatgaaattttggaagagtcagcagaagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacatttt

SEQ ID NO: 326590 - DNA, 1532 bp, Homo sapiens
ttctggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccggggggatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttatattttagctttgaaagccatagaaatcagttatcccagtttttttcctataaaagacccatttttccgtcgacgc

SEQ ID NO: 326591 - DNA, 2233 bp, Homo sapiens
  misc_feature (9)..(9): n is a, c, g, or t
ctcgtgcgnagagagagagagagagagagagagagagagagagagagagagagtagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaatataagtttaatactgtatcagggtttaacttttactatttcagatcttccacagcttgtaatttcatcaagggaatccttttgcattgttaatttgttgggtgtgagtccaccaatgaagtgttatgtgaaaaatttcaaacttgctttataatagattgaagaatttgagagaagtgagagaaagttaaaacacataaaaggaatgtgttacttttgcttaaactacttatggaatagtatggtagtagtaatatggaagagattgctaagttaaaattgtagcttcctatatagtggtgctttttcttttccttcccagttattttcctctttacaaaagatagggcttaagtaagacatggacccagggtgatactacttatgtagtctctataaagagaggtagaacaaaaagcttgttagccaattaagttctggaaaaggaaagaaacaagcttagaaaaccctgtgccttgtcctcaaatattaaggaggagacagaccagtcctagaaagtctaagtcattgctcagggatctctagatactgtctctttgcaactaggtatgaagaagtgttcatgccttgctgagattttccaggcatgtggtcagcctgtcacttactaaactgaaattttaaaatcaggtttcaaatgttaagctttgaccaacctgagaaaatgttaaagtattgtttttaaaaaaatggaaattttttttgtttgtgtttttgttttagtttcgaataaacttagttaccttacacttcccttctacttatccaattatgcatatgtctgggattgaggggccaaaactatagcgaacttgaatgaagtattagggccagttgtcaggtcagggtggcatcttttattttaaggtcctctaaagtcattctgctttaaaacacccctcaaacatacctttaaacttaagatcatagacagacatctcatcaaccagtaaaactttctaaatactaccttgtcacatctattgtgtagttatttaacagattaaatagaagtcatttaataagactccaagtctcagtctgcttgactagtagcataaactcagtctattctattttagaatgtggtggagaaagatgatagttattagattcctttgtcacatcttatacagtccacttgggttaaaggtggaactgtcaagaaaaacgcctttctggcacacagtgatatgcagagcaggaccagctgaagtcagatgtgcaaggaaatctgtggttgctgagcaggatgaaaagtatcctgttagaaagtgagataggtgtgtttttatattgtcctaatgtgaactccttagtcttggttccaaagggaagggtacctgaaaataaatgtatttttatagctgaaaaa

SEQ ID NO: 326592 - DNA, 1080 bp, Homo sapiens
ttctggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccgggggggatagattcccagaagtgggataactggatcagagggtgattaccctgtgtataagagtatgtgtctcactgcaccttcaatggcattgagtagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaggctccggaggtggaaccggtggtggaggtaccccttctaagacaagcaacactatccgtgttttcttgccgaacaagcaaagaacagtggtcaatgtgcgaaatggaatgagcttgcatgactgccttatgaaagcactcaaggtgaggggcctgcaaccagagagctgtgcagtgttcagacttctccacgaacacaaaggtaaaaaagcacgcttagattggaatactgaagctgcgtctttgattggagaagaacttcacgtagatttcctgggcgg

SEQ ID NO: 326593 - DNA, 581 bp, Homo sapiens
ttctggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccgggggggatagattcccagaagtgggataactggatcagagggtgattaccctgtgtataagagtatgtgtctcactgcaccttcaatggcattgagtagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagctgctcgggaggctgaggcaggagaatgggttgaacccgggaggcggacgtttcagtgagccgagatcgtgccactgcactccagagtgagactctgtctca

SEQ ID NO: 326594 - DNA, 616 bp, Homo sapiens
ttttttcctgaatgggatgttggtctcctagtttgagactttaaagttgattctttataatattactgttttaaataacactgggacagacattttttgtacatgtatctttgattgcatctctgttttttttttcttcctgtaggatagattcccagaagtgggataactggatcagagggtgattaccctgtgtataagagtatgtgtctcactgcaccttcaatggcattgagtaggtcagtttttacaatctttgccaatgtgatagatatctgttacattcttgggtggtaatagcagaaatcctcatattattaataatctgtaaaaccatcatagtgtatgaaagaaatttgcaattgtcctgaaatgagtttctttaaaaatattttaggtaaaagtaatctgtgaccaaaaaaaaaattactgattaaagttggaatttcagcatttttttttttggagagctagaattttaatgttcttttattaaaatgacaaacatgagaaagcttgttttatagtatgtaataaatataaatattatgtaaaactaaattatttcagatagatgaggggggtagtcacatggttctgactttgaaaaaacaaa

SEQ ID NO: 326595 - DNA, 491 bp, Homo sapiens
gagatagaataaaaatatcattgtcttcctttgtacagacaggattgtcagatgtaatgggaaacactataattgagtataactaagtataactgaggataattcaagttgatcagttatagactcctcttgtaaacttctatttttgattttttaaaacatttttaaagggaatttaaaatagcactgttactgtagctgtttagcataatttagttctcaagttatgatcagctaaaatcattatttttttattttattgaatacctgcttgtttagtaccattttctgacatcaagagattaaccatacatatatgtatatctgtatccaatgtcttagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaa

SEQ ID NO: 326596 - DNA, 3157 bp, Homo sapiens
ttctggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccggggggatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaatataagtttaatactgtatcagggtttaacttttactatttcagatcttccacagcttgtaatttcatcaagggaatccttttgcattgttaatttgttgggtgtgagtccaccaatgaagtgttatgtgaaaaatttcaaacttgctttataatagattgaagaatttgagagaagtgagagaaagttaaaacacataaaaggaatgtgttacttttgcttaaactacttatggaatagtatggtagtagtaatatggaagagattgctaagttaaaattgtagcttcctatatagtggtgctttttcttttccttcccagttattttcctctttacaaaagatagggcttaagtaagacatggacccagggtgatactacttatgtagtctctataaagagaggtagaacaaaaagcttgttagccaattaagttctggaaaaggaaagaaacaagcttagaaaaccctgtgccttgtcctcaaatattaaggaggagacagaccagtcctagaaagtctaagtcattgctcagggatctctagatactgtctctttgcaactaggtatgaagaagtgttcatgccttgctgagattttccaggcatgtggtcagcctgtcacttactaaactgaaattttaaaatcaggtttcaaatgttaagctttgaccaacctgagaaaatgttaaagtattgtttttaaaaaaatggaaattttttttgtttgtgtttttgttttagtttcgaataaacttagttaccttacacttcccttctacttatccaattatgcatatgtctgggattgaggggccaaaactatagcgaacttgaatgaagtattagggccagttgtcaggtcagggtggcatcttttattttaaggtcctctaaagtcattctgctttaaaacacccctcaaacatacctttaaacttaagatcatagacagacatctcatcaaccagtaaaactttctaaatactaccttgtcacatctattgtgtagttatttaacagattaaatagaagtcatttaataagactccaagtctcagtctgcttgactagtagcataaactcagtctattctattttagaatgtggtggagaaagatgatagttattagattcctttgtcacatcttatacagtccacttgggttaaaggtggaactgtcaagaaaaacgcctttctggcacacagtgatatgcagagcaggaccagctgaagtcagatgtgcaaggaaatctgtggttgctgagcaggatgaaaagtatcctgttagaaagtgagataggtgtgtttttatattgtcctaatgtgaactccttagtcttggttccaaagggaagggtacctgaaaataaatgtatttttatagctgaaaaa

SEQ ID NO: 326597 - DNA, 3251 bp, Homo sapiens
ttctggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccgggggggatagattcccagaagtgggataactggatcagagggtgattaccctgtgtataagagtatgtgtctcactgcaccttcaatggcattgagtagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaatataagtttaatactgtatcagggtttaacttttactatttcagatcttccacagcttgtaatttcatcaagggaatccttttgcattgttaatttgttgggtgtgagtccaccaatgaagtgttatgtgaaaaatttcaaacttgctttataatagattgaagaatttgagagaagtgagagaaagttaaaacacataaaaggaatgtgttacttttgcttaaactacttatggaatagtatggtagtagtaatatggaagagattgctaagttaaaattgtagcttcctatatagtggtgctttttcttttccttcccagttattttcctctttacaaaagatagggcttaagtaagacatggacccagggtgatactacttatgtagtctctataaagagaggtagaacaaaaagcttgttagccaattaagttctggaaaaggaaagaaacaagcttagaaaaccctgtgccttgtcctcaaatattaaggaggagacagaccagtcctagaaagtctaagtcattgctcagggatctctagatactgtctctttgcaactaggtatgaagaagtgttcatgccttgctgagattttccaggcatgtggtcagcctgtcacttactaaactgaaattttaaaatcaggtttcaaatgttaagctttgaccaacctgagaaaatgttaaagtattgtttttaaaaaaatggaaattttttttgtttgtgtttttgttttagtttcgaataaacttagttaccttacacttcccttctacttatccaattatgcatatgtctgggattgaggggccaaaactatagcgaacttgaatgaagtattagggccagttgtcaggtcagggtggcatcttttattttaaggtcctctaaagtcattctgctttaaaacacccctcaaacatacctttaaacttaagatcatagacagacatctcatcaaccagtaaaactttctaaatactaccttgtcacatctattgtgtagttatttaacagattaaatagaagtcatttaataagactccaagtctcagtctgcttgactagtagcataaactcagtctattctattttagaatgtggtggagaaagatgatagttattagattcctttgtcacatcttatacagtccacttgggttaaaggtggaactgtcaagaaaaacgcctttctggcacacagtgatatgcagagcaggaccagctgaagtcagatgtgcaaggaaatctgtggttgctgagcaggatgaaaagtatcctgttagaaagtgagataggtgtgtttttatattgtcctaatgtgaactccttagtcttggttccaaagggaagggtacctgaaaataaatgtatttttatagctgaaaaa

SEQ ID NO: 326598 - DNA, 3160 bp, Homo sapiens
  misc_feature (140)..(140): n is a, c, g, or t
ctacctgttttggtagccccctcttgtgattaaacgtttgcttgtaaggttttgccccttattctccttttcatacatgtaaagaacttgctgtgctcctttatagcctacaggtaaacttctcttctagtgagagtatngacaggagatggcttatattcccctgtttttgtaaggggaatatcctcagggttggcttcctcatttttgctgaaactagctgcactgaacgtctcataggatgaggtcacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaatataagtttaatactgtatcagggtttaacttttactatttcagatcttccacagcttgtaatttcatcaagggaatccttttgcattgttaatttgttgggtgtgagtccaccaatgaagtgttatgtgaaaaatttcaaacttgctttataatagattgaagaatttgagagaagtgagagaaagttaaaacacataaaaggaatgtgttacttttgcttaaactacttatggaatagtatggtagtagtaatatggaagagattgctaagttaaaattgtagcttcctatatagtggtgctttttcttttccttcccagttattttcctctttacaaaagatagggcttaagtaagacatggacccagggtgatactacttatgtagtctctataaagagaggtagaacaaaaagcttgttagccaattaagttctggaaaaggaaagaaacaagcttagaaaaccctgtgccttgtcctcaaatattaaggaggagacagaccagtcctagaaagtctaagtcattgctcagggatctctagatactgtctctttgcaactaggtatgaagaagtgttcatgccttgctgagattttccaggcatgtggtcagcctgtcacttactaaactgaaattttaaaatcaggtttcaaatgttaagctttgaccaacctgagaaaatgttaaagtattgtttttaaaaaaatggaaattttttttgtttgtgtttttgttttagtttcgaataaacttagttaccttacacttcccttctacttatccaattatgcatatgtctgggattgaggggccaaaactatagcgaacttgaatgaagtattagggccagttgtcaggtcagggtggcatcttttattttaaggtcctctaaagtcattctgctttaaaacacccctcaaacatacctttaaacttaagatcatagacagacatctcatcaaccagtaaaactttctaaatactaccttgtcacatctattgtgtagttatttaacagattaaatagaagtcatttaataagactccaagtctcagtctgcttgactagtagcataaactcagtctattctattttagaatgtggtggagaaagatgatagttattagattcctttgtcacatcttatacagtccacttgggttaaaggtggaactgtcaagaaaaacgcctttctggcacacagtgatatgcagagcaggaccagctgaagtcagatgtgcaaggaaatctgtggttgctgagcaggatgaaaagtatcctgttagaaagtgagataggtgtgtttttatattgtcctaatgtgaactccttagtcttggttccaaagggaagggtacctgaaaataaatgtatttttatagctgaaaaa

SEQ ID NO: 326599 - DNA, 1310 bp, Homo sapiens
ttctggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccggggggatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtctttt

SEQ ID NO: 326600 - DNA, 4242 bp, Homo sapiens
ggcggactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaaagctc

SEQ ID NO: 326601 - DNA, 1146 bp, Homo sapiens
ggcggactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatat

SEQ ID NO: 326602 - DNA, 3375 bp, Homo sapiens
gcggccgcctactactactactactactgctcgaattcaagcttctaacgatgtacggggacatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaaagctc

SEQ ID NO: 326603 - DNA, 2565 bp, Homo sapiens
ttcattttttggttgatttttttgccttcccttcaattttaaactgaagcattttaatgtgggtagaaactctacaccaaatacactaaacattttggtgcttagtggatttctttttaggtaactggcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaaagctc

SEQ ID NO: 326604 - DNA, 4983 bp, Homo sapiens
ggcggactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaaagctcaaaaaaaaaaaaaaaaaaaaaaaaaaaaaaaaaaaaaaaaaaaaaaaaaaaaaaaaaaaaaaaagagagggggggcggggacaaaaaaatcctcacccagaggggggcgcaccaaaataagcgcgagacacccagttttttggagcaaacaaggggcgcccaataaaagggggagtaatataaaacgaaacgcggcgggcgagggattaaaacacaaaggggaagaacggagcaaaaccagtggaaacggggacatctggaaaaagcgacaccactacgcggggggcgcaccaacatgcggcacactccccaaagaaaatatacagcccacgaggaaaatacacacaaacaacggggcataccgcgtgtgtcacacaaacacggacgaaaaaagaaaagcggaatagaagaaattcgtcaacagagagcaaaacagaacaaaccaccttacccgccgcgcctgccgcacacatacacccaaaaaaaaacaaaaagaacaacacaaaggaaaaaaagcaggacagaacgcgagaagcaaacgaagaagacacaaaaaggctcacaaccacacaaaacacaacaacaaaaacaaaaaaaacatacaaagagagaaacaacaccacataccaaacaccaaaacaaaccaaacaagcagaaaacaaacacaaagaaacaagaacatagacgaacaagacgaaatgaacaaaacaaaagaacaaacagagcacagaaacgacacaa

SEQ ID NO: 326605 - DNA, 2043 bp, Homo sapiens
ggcggactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcggtgggggccccttaatgggggtttatcacctcttccaaaaagcttttttgttgggtggaactagttccgcccc

SEQ ID NO: 326606 - DNA, 4033 bp, Homo sapiens
ggcggactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaaagctc

SEQ ID NO: 326607 - DNA, 4503 bp, Homo sapiens
ggcggactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaaagctcaaaaaaaaaaacaaacacacagaacaacaacatttgtggcccaatctaggccccagaaaaagttacaaaacattcgtgggagcgcggggcccagaggaatgagcacggcacagaccgtgcccaaggacaccggcacgaacaaggcggttccccccaaaaaaacgcggcggaccgagccgctgacaacagagggcggagctcgggccaacaggccaagagaaagacaccgcgaggacccgagacgagcagagcacaccacac

SEQ ID NO: 326608 - DNA, 2590 bp, Homo sapiens
actggttcctcccctctcaactgctctggttcttataaaaacctcacagccttccactaacatcccataggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326609 - DNA, 682 bp, Homo sapiens
actggttcctcccctctcaactgctctggttcttataaaaacctcacagccttccactaacatcccataggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgat

SEQ ID NO: 326610 - DNA, 757 bp, Homo sapiens
actggttcctcccctctcaactgctctggttcttataaaaacctcacagccttccactaacatcccataggagcctctctccctactgctgctacacaagaccctgagactgacctgcaggacgaaaccatgaagagcctgatccttcttgccatcctggccgccttagcggtagtaactttgtgttatggagagtggcagaaagaagaaaacttcggctttgatatcgtttcagttctctctctgaactggcatcgtgcccaggaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgat

SEQ ID NO: 326611 - DNA, 784 bp, Homo sapiens
ttagaggatcctcagtcttgctcccatcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatgaaaaaaaaaaaaaaaaaaaaaaaaaaaaatttttggggggattgggcactggaaaaggtttttgaaaacaaattggatggagacgacggggccccaaaaagggaaagggaaccacgtggcaatagcggtgttctcacacaagagagaacagccgggggcacagggcaagaacgggctggaggtattcacgcacccaagataaaaaaaagcgccgggggggaccaaccaggaaggctgtcagaaaaacaacgccagagaaggggacatcaggaagagcactatagggggaatacataacaacaggggggacccacaggaaacgccgaagacagaatatagcg

SEQ ID NO: 326612 - DNA, 898 bp, Homo sapiens
tcaccatgttgtccaggctggtctcgaactcctggcctcaagtgatccacccaccacagcctcccaaagtgccgggattacaggcatgagccaccacacccagccagctgattgctgttgaatagctggatttataaagactgagcataggaggaaatggcacatcactctcatttttaatttattcattatttttatagtgtttaaactgttcatgtatcggcaatctagttatgcttcataaatcctcaggacagagaatttctcctcaaaaggaatttaaaatctaccaagtagaaatacagaaattaagaaaggcaaagtgatcgtccaaactcaaaaccaacaaagcctatatgacaagtctctaagacacatggattgattactgatttcatttgatcaggaagttaatgaaatctactttatactctcctttaatttttgccaatctccgtttatatgagttgcataagttaaggcactttcaaatatatttgtgtcaaggaatattcacggaaatatttccagctatgtgtcgctaaaactgcatttatttattttctgttctaagatcccttcattaacaggagaaatgcaaataccttcatatcccctcagcagagatggagagctaaagtccaagagaggtcagtaacaaaacttcatgaggagtggtcatttttcccagtgtagatcacagatctgaattggagtgggaaacagctttttcatcatatacattatttctaattgtatctttaaaatcaaaaaacttaaaagcaatattcagaaaacaactgaattattagaaaattatttggggaaagatccggaaaggagaaggaaggaggagagaaaggaggacagaaagaaaacttctattttcattaaaaaa

SEQ ID NO: 326613 - DNA, 366 bp, Homo sapiens
gcggccgcctactactactactactgctcgaattcaagcttctaacgatgtacgggtacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgat

SEQ ID NO: 326614 - DNA, 2560 bp, Homo sapiens
  misc_feature (2)..(3): n is a, c, g, or t
  misc_feature (5)..(5): n is a, c, g, or t
  misc_feature (18)..(18): n is a, c, g, or t
  misc_feature (30)..(30): n is a, c, g, or t
tnntnacccctttggaanaccctgactctntggatccccatatcgtgctgccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326615 - DNA, 2642 bp, Homo sapiens
gcccgactctatgaggatcccctgccatttactccatggccccatctgggatgtgaggagcgcctctgcccggccgagaccccgtctgggaggtgaggagcgtctctgcccggccgccccgtctgagaagtgagctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326616 - DNA, 2564 bp, Homo sapiens
gccgtcctcctcttgctgctgacctcctcctgctgctgtcctattcctgctgctgtctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326617 - DNA, 2941 bp, Homo sapiens
tcaccatgttgtccaggctggtctcgaactcctggcctcaagtgatccacccaccacagcctcccaaagtgccgggattacaggcatgagccaccacacccagccagctgattgctgttgaatagctggatttataaagactgagcataggaggaaatggcacatcactctcatttttaatttattcattatttttatagtgtttaaactgttcatgtatcggcaatctagttatgcttcataaatcctcaggacagagaatttctcctcaaaaggaatttaaaatctaccaagtagaaatacagaaattaagaaaggcaaagtgatcgtccaaactcaaaaccaacaaagcctatatgacaagtctctaagacacatggattgattactgatttcatttgatcaggaagttaatgaaatctactttatactctcctttaatttttgccaatctccgtttatatgagttgcataagttaaggcactttcaaatatatttgtgtcaaggaatattcacggaaatatttccagctatgtgtcgctaaaactgcatttatttattttctgttctaagatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326618 - DNA, 2447 bp, Homo sapiens
ctgagccaccgcacccagcctctccctgttctttaaatatctcttaatataggggggcatggagagaaagtctctccaatattttcttcttcttttccatttttgtatttttccactttatccttctcaattttggcctcttcttccactttctaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326619 - DNA, 2350 bp, Homo sapiens
ttagaggatcctcagtcttgctcccatcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326620 - DNA, 2584 bp, Homo sapiens
gcccgactctatgaggatcccctgccatttactccatggccccatctgggatgtgaggagcgcctctgcccggccgagaccccgtctgggaggtgaggagcgtctctgcccggccgccccgtctgagaagtgagctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326621 - DNA, 2274 bp, Homo sapiens
gcggccgcctactactactactactgctcgaattcaagcttctaacgatgtacgggtacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326622 - DNA, 2496 bp, Homo sapiens
gaaggctttttctgatttttgacaaatgaattttgcacactttcattggtgtctttcggcaacttacacacattgaaaatgagctatgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326623 - DNA, 837 bp, Homo sapiens
  misc_feature (2)..(3): n is a, c, g, or t
  misc_feature (5)..(5): n is a, c, g, or t
  misc_feature (18)..(18): n is a, c, g, or t
  misc_feature (30)..(30): n is a, c, g, or t
tnntnacccctttggaanaccctgactctntggatccccatatcgtgctgccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatgacaacacaaaaaaaaaaaattttggccccctggcccggaaaagttttaacactttcggttgggccggcgccctggtattgaacgtggcgccgttcccaggaacccggcgacaggcgggttccccccaaaccccgggcccggctttgacacccaaggtcgggcagggctccacgggccgagcttc

SEQ ID NO: 326624 - DNA, 358 bp, Homo sapiens
actggttcctcccctctcaactgctctggttcttataaaaacctcacagccttccactaacatcccataggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagacgctctagcctgtccacgagctgggatcctctagatcacctgcggcaaca

SEQ ID NO: 326625 - DNA, 2557 bp, Homo sapiens
  misc_feature (183)..(183): n is a, c, g, or t
attatatacacgcaaattgcccgaccgaaactctaagcacattctgtgacttaccgacacttgaacttacagacaccgggccgacgcatccactacgtcagtcatcatcgtcattgcttctctgcggtggtaaaaacggcggccgtcagtgttatgaactctcctgaaagcatggaatcttangaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326626 - DNA, 2532 bp, Homo sapiens
actggttcctcccctctcaactgctctggttcttataaaaacctcacagccttccactaacatcccataggagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactttcatcttgtaaatctgctttctttgggaagatattgagatatttaaatcatggcccaccttacccaaaataggagattctgttcatctcatatctagtattaattagaaaaataactacataaaaagaaggaagctaagaaggcactcactcagccataaattctctaaaccctctctaccttggaatccgtgaatggaatctggtatgttttttgcaggattttcctattgtaaattgtggcaaatacagggctcccttcatttgcttttcatctcttatgcatcaaagtcaaaaacatttctgaatcaagataatctagaagagaaaaaaggaggaaaaggaaaagagaaagcagaagggacaaataaaagcaattggcaaaaactgtcaataatagtttatacacttaactatatcaataatcacattatatgtaaatagtctaaacaatccaattattttttacttctacttatgttatatttttacttctacatttgttaaaggttccacgctacatttttactattcttgctttaaataattttaataatttcttttaaagtttagataataagaaaatatcccgggccaggcacagtggccacacctgtaatctcagtagccatgaccataccaatgcactccagcctgtgaaacagagtgagactctgtctctacagaaaaataaaaaagaaaagaaagaaaagatctcatatatttacccatgtaattttcatttcctgttttcttcattcttctttccatctggtgtcacttcctttctgcctgacgacttcctttaacgttttttatagttcaggtctgcaggattctttaagttttgtatgcttgtttttattcttgaaagatattttcactgtatattgaatcccaagttgccacgtttcttttaattattttaaggtattccactgaattctagcttgcacaatttttcgatataaaatttgttgtaattcttacctttgttccactgtgtatactgcatcttttatctctggctgcttctaacatttttatctttattagtgcttttgaccaaattgattcagacctatcttgatttgatttttcttatttttcttgttcttgaggcttattgaccttcttggattgcataaaattagaaaaattttcagccattattttttcagatactttgatccctcactcctcctctcctttagagggtccaatgacatgcacatttgaccacttgaagtaatccaactctctgatgttattttaatttttacaaattgcttttctctgtgtgttttatttttgacactttctattaatgtgtcatcaggttcattaaccttttctttggcaatatctaatctactattaatttcatctagtgtatttttcatgccagacattgtggttttaatcaccagaagtttgatttggatgttttcatatcttccacgcctctacttatctttttaaatgtctttgatacatttaaattgttccaataactattttaacataatgtcagttatgggttggtttgattggttgattattctacttatgaaccacaattttctacttttctgcattcttgcttaattttatttgacgccagacatcatttgatgccagacatttatttgatgccaaaatgcagaaaattttattttctgcattcttgcttaattttatttgatgccagactttttgtgtactggatattcttctatttctgtatgtgttcctgagctctgctctgggattccgttaaatgatgtggataaaattgatcagtatttaatctaaggctaattatttccccacactgaggcaagacctttctgagcactgcgcccaatgtcccatgacaataaacatagccctgagttaacagca

SEQ ID NO: 326627 - DNA, 6286 bp, Homo sapiens
  misc_feature (660)..(660): n is a, c, g, or t
  misc_feature (772)..(772): n is a, c, g, or t
tgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccntaacttctggaaaggtgcgccatggagctctcacatgcctgtgtgtggctatgaaaaggcaggtcctctgttatgaactatttcagagcaagaccgtcacagaaaatttaangaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctccggaggcatggaccaaggaagtgatgccccagcgagggactttgacggagaggactctgactctccgaggcattccacagcttccaacagttccaacctaagcagccccccaagcccagtttcaccccgaaaaaccaagagcctctccctggagagcactgaccgcgggagctgggacccgtgagctgcctcagcactgggacctctcgctctccgctccctgccactcacctcctctcactttcatctcttccctccacctcgcctgctcggcctgaaagccaccaggggctggcagcagtagcaggacagggcttcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacggttctgtcacctctgatcccttccatctgaaagggtacaaggagtgttgtagcttctgaaggtgcagaaaacaatttctaaaaatgcttttattcctgggctaatcctgtccctccctaagtcgcagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcggcttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccatttagaggagtcagtagcaaagctcacagataaagtattttattactatctgaagttttcttttgttttcatgcaggacattttaaaaacgtatgtggcagcagaaacttgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatatatttatacacacccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaacctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 326628 - DNA, 6472 bp, Homo sapiens
  misc_feature (660)..(660): n is a, c, g, or t
  misc_feature (772)..(772): n is a, c, g, or t
tgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccntaacttctggaaaggtgcgccatggagctctcacatgcctgtgtgtggctatgaaaaggcaggtcctctgttatgaactatttcagagcaagaccgtcacagaaaatttaangaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgccaggtttcccttatccatcccctcatcatcactccggtctgatctcctctccgatcaactttgaacacatctatcacatgactgttaattctgctgaaaaatttctctctcctgattccataaaccctgaatattccccgtctctgcgctctgtccctggtacaccaagctttatgactctgaggaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctccggaggcatggaccaaggaagtgatgccccagcgagggactttgacggagaggactctgactctccgaggcattccacagcttccaacagttccaacctaagcagccccccaagcccagtttcaccccgaaaaaccaagagcctctccctggagagcactgaccgcgggagctgggacccgtgagctgcctcagcactgggacctctcgctctccgctccctgccactcacctcctctcactttcatctcttccctccacctcgcctgctcggcctgaaagccaccaggggctggcagcagtagcaggacagggcttcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacggttctgtcacctctgatcccttccatctgaaagggtacaaggagtgttgtagcttctgaaggtgcagaaaacaatttctaaaaatgcttttattcctgggctaatcctgtccctccctaagtcgcagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcggcttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccatttagaggagtcagtagcaaagctcacagataaagtattttattactatctgaagttttcttttgttttcatgcaggacattttaaaaacgtatgtggcagcagaaacttgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatatatttatacacacccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaacctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 326629 - DNA, 6446 bp, Homo sapiens
  misc_feature (660)..(660): n is a, c, g, or t
  misc_feature (772)..(772): n is a, c, g, or t
tgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccntaacttctggaaaggtgcgccatggagctctcacatgcctgtgtgtggctatgaaaaggcaggtcctctgttatgaactatttcagagcaagaccgtcacagaaaatttaangaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgccaggtttcccttatccatcccctcatcatcactccggtctgatctcctctccgatcaactttgaacacatctatcacatgactgttaattctgctgaaaaatttctctctcctgattccataaaccctgaatattccccgtctctgcgctctgtccctgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctccggaggcatggaccaaggaagtgatgccccagcgagggactttgacggagaggactctgactctccgaggcattccacagcttccaacagttccaacctaagcagccccccaagcccagtttcaccccgaaaaaccaagagcctctccctggagagcactgaccgcgggagctgggacccgtgagctgcctcagcactgggacctctcgctctccgctccctgccactcacctcctctcactttcatctcttccctccacctcgcctgctcggcctgaaagccaccaggggctggcagcagtagcaggacagggcttcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacggttctgtcacctctgatcccttccatctgaaagggtacaaggagtgttgtagcttctgaaggtgcagaaaacaatttctaaaaatgcttttattcctgggctaatcctgtccctccctaagtcgcagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcggcttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccatttagaggagtcagtagcaaagctcacagataaagtattttattactatctgaagttttcttttgttttcatgcaggacattttaaaaacgtatgtggcagcagaaacttgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatatatttatacacacccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaacctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 326630 - DNA, 324 bp, Homo sapiens
gtcactcgggctgcaaactgcagttttcccagaggcattcagacttctggcttttgtgtgaaaataccatcatctgtaaaggcctacagaaaggacggagcttgtatgttccgtgcctcttcctcagctcatagaaggggctttataccgacagtgaggccgccccatggggttatttggtcagggtggctggagggggcggtggtaatctgagccccttctgcctccctttctccccctccttctcattaatgttttactttgggccttacaggactctgactctccgaggcattccacagcttccaacagttccaacctaag

SEQ ID NO: 326631 - DNA, 567 bp, Homo sapiens
gtcttgttatcttgggtagtatttacaatgtaagctgaacttcatcttacaccaagtttgacttttatgctatttagaaagaaacccatgagtgttattttaatgaaatatgagtgaaagttaaaatggtaccattaaaatgtttctcagaataaaaagtcattctgtatttgaagaatgtgttctcacattttctcatagcttaatgatatgtgtctcatctgctactttaccaaccagaatggcagacttataaaacgtgtacattatctgtaggtcttcaccatgcaattacatatgtaatttaagggatattttcatttgagttgttttggctgtttgtctgtctaaaacaaaactaagattcctaagccagctggagtgaagaaagggtggcagagagcactggctatagtgtgtgacttcaaactctttctgtacgatattgctgaaggaaaagcatctcagcccagtgttgtcattagtcaagtgattgacatgaggtaagagtttgaaggtaaaattatttgtatcattgcaacataggaattttaaagtttctgattt

SEQ ID NO: 326632 - DNA, 2542 bp, Homo sapiens
  misc_feature (660)..(660): n is a, c, g, or t
  misc_feature (772)..(772): n is a, c, g, or t
  misc_feature (1735)..(1735): n is a, c, g, or t
tgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccntaacttctggaaaggtgcgccatggagctctcacatgcctgtgtgtggctatgaaaaggcaggtcctctgttatgaactatttcagagcaagaccgtcacagaaaatttaangaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaagtaagtgccggggctacaggaaggtgcctctgagacagggtgacccccagctccctcccctcctgtcccgtgggtgacatgtccttcacttacgtgtgcccattgcattctcaagnggctgcagtgtctcagaccctgctgggtaatgcctaataggcacaaatgcagttgttaagaaaatagtcccagagtccttctagagtgtacaggccatctgggagacagacaaatatgattacaaattgtgatgataaaggctctgaaggaagtaaacagcatacattaatagagaataacaaggggtagctgttagggatgaatccctacttggcagaataattaggaaaatcactccctagaggtggagtcatgtttgagtaatgtttggttaactgaaagaaggctagtatggctacatggtagtggtgaggaagtaacaaaaattagagcggggtagcaggtaagggtcagaccagcagggacttgaagaccaaggtaagacattttttactttattcaaaaggaaaaggaagacttttaagtagggaagaattttctttcaatttacattcttaaaacaatcctgcgggctgccaagtggagaatggactagaggcaggaagagtggaagccagcatccagataggagactcctagagtggtcccaatggaaaccaatgagggcttgggatgcagcaggggcagaaggagagaagatggtagattctccagatatattttcagagttaaaagcagtaagacttgatgatgaattagtcatggaaaagtaagggagagagttaaagatgactcccagacttcctgctagggccttagtatgataccatttactcccatttaccaccgtttaagaaggggctgaggcaggacattccacgcatgtccaaaggtcccgaggtagc

SEQ ID NO: 326633 - DNA, 5659 bp, Homo sapiens
  misc_feature (660)..(660): n is a, c, g, or t
  misc_feature (772)..(772): n is a, c, g, or t
tgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccntaacttctggaaaggtgcgccatggagctctcacatgcctgtgtgtggctatgaaaaggcaggtcctctgttatgaactatttcagagcaagaccgtcacagaaaatttaangaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctccggaggcatggaccaaggaagtgatgccccagcgagggactttgacggagaggactctgactctccgaggcattccacagcttccaacagttccaacctaagcagccccccaagcccagtttcaccccgaaaaaccaagagcctctccctggagagcactgaccgcgggagctgggacccgtgagctgcctcagcactgggacctctcgctctccgctccctgccactcacctcctctcactttcatctcttccctccacctcgcctgctcggcctgaaagccaccaggggctggcagcagtagcaggacagggcttcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacggttctgtcacctctgatcccttccatctgaaagggtacaaggagtgttgtagcttctgaaggtgcagaaaacaatttctaaaaatgcttttattcctgggctaatcctgtccctccctaagtcgcagcgaggtgtctgtcccagggctggagatgcttcccaaggaggagtctgttttgttgagagtgggcgtgggcttcttcacataagcctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcggcttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccatttagaggagtcagtagcaaagctcacagataaagtattttattactatctgaagttttcttttgttttcatgcaggacattttaaaaacgtatgtggcagcagaaacttgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatatatttatacacacccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaacctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 326634 - DNA, 3454 bp, Homo sapiens
  misc_feature (660)..(660): n is a, c, g, or t
  misc_feature (772)..(772): n is a, c, g, or t
tgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccntaacttctggaaaggtgcgccatggagctctcacatgcctgtgtgtggctatgaaaaggcaggtcctctgttatgaactatttcagagcaagaccgtcacagaaaatttaangaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctccggaggcatggaccaaggaagtgatgccccagcgagggactttgacggagaggactctgactctccgaggcattccacagcttccaacagttccaacctaagcagccccccaagcccagtttcaccccgaaaaaccaagagcctctccctggagagcactgaccgcgggagctgggacccgtgagctgcctcagcactgggacctctcgctctccgctccctgccactcacctcctctcactttcatctcttccctccacctcgcctgctcggcctgaaagccaccaggggctggcagcagtagcaggacagggcttcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacggttctgtcacctctgatcccttccatctgaaagggtacaaggagtgttgtagcttctgaaggtgcagaaaacaatttctaaaaatgcttttattcctgggctaatcctgtccctccctaagtcgcagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaagga

SEQ ID NO: 326635 - DNA, 6597 bp, Homo sapiens
ccttattctcactgtgtgtgactatgctggtcataaatgtgttcatacccactatgtgtctataagacaaaacctattctgacttgtcttttcccatgctttttcatctttctactctaggctaagagtagaggtagatcttggagaagagggacctgacaaaattttaatgtagttgtctttttctttgacaaaggaaggaaagcccatctcaagaggtcctttctttttctgtgttttgctttctccatcatttcttaagaggtcaaagtgttcctgcagccctctgcctgtccaaaatctcccattgccaccctgagtctccaagacctgctttaccctcataattctcaaattccaaatttgtgtcccacattctcattcacttcaaaaattctgttctttggctgggcatggtggcgcatgtgcctgtaatcccagctctttgggaggccaagacaggaggatcacttgagcccaggaggtcgaggctgcagtgagctatcatggtgccactacacttcagcctgggcaacagagcaagaccctgcctcaaataaataataataataataataataataataattctatttttaaaatatttactgttaggaaagcagtctgcctaagccatatgattatgccacgaggatcatgttgcatttctgctaattatcacctttgttttcttctaggctcgtttggcttcttctcacctcctccttctcacttcagctttttgggtgttgaaaatttctaaactttgctctttttccttatcttatttagataatgacaccatttgttgtgttatatggatacagttgtctatttttttcttattttcacacagcccagcatgttttgggagtccctggcagacagttttgtttacttctagatattaaaactgacatcggataagactatcactgggttgctaggtgtatatgattaaacatcatctacccccaagatcagaagaggagaaatagcgacagattcttaccttttataaaggaagggtagtggaagcacagctccttctttttactccgtatctcatagactgaaccttgcaaaggaaatttttttattatgtaaagatagttgtaattgttatttaccacttatggtaaatcaggcttaccatttatgccgattactgttcagggtaacagtagtagctctttaacaacaccctaagccattgaaatcaatacctggagggagagaaaatatagtattgagatactggggtggggtggctgattagtgacagaacaccaaggcaactgcagttttcttctagtaaaattatgtcctactgtgtttataatcaagtaaaagtgaaagtagattttgcaagctatgtttactttcagcatattatctgtttacataggttctgttaaatattatttactgggttatcaacacaacatttaaaaaccagaattgcatgtacttgtactatcaatgtttgtactgtcttggaggttaatagataaaaagcattttaacagtttaaagaacatcattatcgtttgtatttttattttaacagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctccggaggcatggaccaaggaagtgatgccccagcgagggactttgacggagaggactctgactctccgaggcattccacagcttccaacagttccaacctaagcagccccccaagcccagtttcaccccgaaaaaccaagagcctctccctggagagcactgaccgcgggagctgggacccgtgagctgcctcagcactgggacctctcgctctccgctccctgccactcacctcctctcactttcatctcttccctccacctcgcctgctcggcctgaaagccaccaggggctggcagcagtagcaggacagggcttcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacggttctgtcacctctgatcccttccatctgaaagggtacaaggagtgttgtagcttctgaaggtgcagaaaacaatttctaaaaatgcttttattcctgggctaatcctgtccctccctaagtcgcagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcggcttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccatttagaggagtcagtagcaaagctcacagataaagtattttattactatctgaagttttcttttgttttcatgcaggacattttaaaaacgtatgtggcagcagaaacttgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatatatttatacacacccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaacctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 326636 - DNA, 585 bp, Homo sapiens
cattgaaaaccactgttgagatggagccatctggagtctgcaggcctggccaggtcccatttgctaaatgagggcattgtttgcagagaaagagcatcctcctcaaaggcatattaatgacaagccagacactggacaaccaagaatggacccagctaacatcatggataaagggaaacctgacatgcgacagcagaaccagagagtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaaccctatgggggctgccacgtcacaggcccaaaggactcttcttcagcagcatctttgcaaaatgtctttctctcaatgaagagcatatctggacgactgtgcaatgctgtgtgctcccgggatcagtaacccttccgctgttcctgaaataacctttcataaagtgctttgggtgccattcca

SEQ ID NO: 326637 - DNA, 626 bp, Homo sapiens
acctaccctgatcctctgtaatcaaaagtgttttcccgctctcaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtaagcacagtcacatggtggctgcagaaggctatttgatggtttgttggtttttaattatggttacacattcatgtgtttatttttatcctgttttgttccagaaaggatttgaggtagtgtacatacatgtataggatagaagatttaataaaaacaaagtgaaatttgggaccatagggaaataaagtagaaattatacctggattcctgatttaatttctataattcataaaatatgtgcagggcattcctgagaaactgccagaagggcagctctgtgcgatgctaaaaggggcagtaagccatggcttccataatacaagaaaaataaatcaagcactcca

SEQ ID NO: 326638 - DNA, 2316 bp, Homo sapiens
ttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggtctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaaccctatgggggctgccacgtcacaggcccaaaggactcttcttcagcagcatctttgcaaaatgtctttctctcaatgaagagcatatctggacgactgtgcaatgctgtgtgctcccgggatcagtaacccttccgctgttcctgaaataacctttcataaagtgctttgggtgccattcca

SEQ ID NO: 326639 - DNA, 2015 bp, Homo sapiens
ttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttgggtaagcaactaaattcagcttgaaccccattctcctttgttcctccctcccctaaagctcatcacatatttgctttagttagatccagggaagactatgacagcctaaagcaactcttttccttctgcttagaagaggggtatagaatcctgatgatgcatgaagagtgtcaatgatgtcatgagagttgaggctttctcagtcatggcccctttaagccttgcttaaggtcacccacatctaatccctttatactgttttgaacagtgtgaaattaaatgaagagtggtgttaacaaagttttacagcaacccacacagctgttggagcaaaccacatgctgtccttattttgttgcagccattttttttttctgtttcataagcctagccgggcagagcagaaattactcagtatttacccgaccactcacaccttgaggcatttaatgctggtgtcctagtttcctatgaataatggatttgcagctcccggggaaagaaaagggaagaaaagaggaaagccaaactaacacagcaacaggcttaagtttgtggggtgttaagcttacaagatttgagggttcctcatgaaaaaaagaatatctacttaaaaatacaaaatcaaataggaaaatgaataatttttaaaacaatcacagaaatcttaacaaattcctggagtctcagaaattcagttccctttcttttgagatctcatttctggtttaccagaactgtttacatggaaacatgttctggcctcccctctccacctagaatactcttagaaaatgaaagtgccaacacagctcatgttatttttttttttttttgaggccaagtctcactctgttgccaggctgaagtgcaatggccacaatcttggctcactgcaaccacagctcacgttttttaattgc

SEQ ID NO: 326640 - DNA, 1035 bp, Homo sapiens
gcaccaattgcatcactgaatctgtgcctccccctttttgatgggcttcttttttttttcttaggccgaacaactgggatgtccatcaggattcaaactgtaatggcatttgggtaagcaactaaattcagcttgaaccccattctcctttgttcctccctcccctaaagctcatcacatatttgctttagttagatccagggaagactatgacagcctaaagcaactcttttccttctgcttagaagaggggtatagaatcctgatgatgcatgaagagtgtcaatgatgtcatgagagttgaggctttctcagtcatggcccctttaagccttgcttaaggtcacccacatctaatccctttatactgttttgaacagtgtgaaattaaatgaagagtggtgttaacaaagttttacagcaacccacacagctgttggagcaaaccacatgctgtccttattttgttgcagccattttttttttctgtttcataagcctagccgggcagagcagaaattactcagtatttacccgaccactcacaccttgaggcatttaatgctggtgtcctagtttcctatgaataatggatttgcagctcccggggaaagaaaagggaagaaaagaggaaagccaaactaacacagcaacaggcttaagtttgtggggtgttaagcttacaagatttgagggttcctcatgaaaaaaagaatatctacttaaaaatacaaaatcaaataggaaaatgaataatttttaaaacaatcacagaaatcttaacaaattcctggagtctcagaaattcagttccctttcttttgagatctcatttctggtttaccagaactgtttacatggaaacatgttctggcctcccctctccacctagaatactcttagaaaatgaaagtgccaacacagctcatgttatttttttttttttttgaggccaagtctcactctgttgccaggctgaagtgcaatggccacaatcttggctcactgcaaccacagctcacgttttttaattgc

SEQ ID NO: 326641 - DNA, 707 bp, Homo sapiens
ttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggtctccagccaacgatgaccagtccaggcccagcctctcgaatgggcacacctgtgtaggtatgcaaataaatatttttgtattttctatgtagacataacaatgggatccagtactttgcttgcgtaataaatcacatattttattaaatcaagaattgtaagattccaggtaaggcaccagtaacctcactgacacagagaaatgtggagtctaagagtagacattgacactacatacatctatgtgaataaaaagcatactagtttaaattgggcataaaactcttccacctcattggc

SEQ ID NO: 326642 - DNA, 725 bp, Homo sapiens
gccatttgtacgtgactagaatttaatgtgcagagctgctgtctgctgatggcttggagaaatgaaagtagagtaggatggggaagatcgatttctttgttctgcctgaattgtctcactaaagccaaagtctagatttcatgaaattctccctgtttcctctctcttcagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaaccctatgggggctgccacgtcacaggcccaaaggactcttcttcagcagcatctttgcaaaatgtctttctctcaatgaagagcatatctggacgactgtgcaatgctgtgtgctcccgggatcagtaacccttccgctgttcctgaaataacctttcataaagtgctttgggtgccattcca

SEQ ID NO: 326643 - DNA, 2370 bp, Homo sapiens
ttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaaccctatgggggctgccacgtcacaggcccaaaggactcttcttcagcagcatctttgcaaaatgtctttctctcaatgaagagcatatctggacgactgtgcaatgctgtgtgctcccgggatcagtaacccttccgctgttcctgaaataacctttcataaagtgctttgggtgccattcca

SEQ ID NO: 326644 - DNA, 2429 bp, Homo sapiens
ttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtggctttgctgttgttggcggatcatttctggaaaaaggtgcagctccagtggccccaaatcctgggaaaggagaatccgttcaacccccagattaaacaggtgtttggagaccaaggcgggcactgagcctctcaggagcatgcacccctggggagcacagggaggcagaggcttgggtaaactcattccacaaaccctatgggggctgccacgtcacaggcccaaaggactcttcttcagcagcatctttgcaaaatgtctttctctcaatgaagagcatatctggacgactgtgcaatgctgtgtgctcccgggatcagtaacccttccgctgttcctgaaataacctttcataaagtgctttgggtgccattccaaacaagagagtatctgtgccctttacagctaattgttctaaaaggagtttctaaaaaca

SEQ ID NO: 326645 - DNA, 2337 bp, Homo sapiens
ttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaagcttgtctagaaacaaggtgttggactatcccgccatcgttatatatgccatgattggaaatgatgtctgcagtgggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtcagcccctgccacggctggatgtcttccaacaagacgttgcggactctcacttcagagagagcagagcaactctccaacacactgaaaaaaattgcagccagtgagaaatttacaaacttcaatcttttctacatggattttgccttccatgaaatcatacaggagtggcagaagagaggcggacagccctggcagctcatcgagcccgtggatggattccaccccaacgaggtaagcacagtcacatggtggctgcagaaggctatttgatggtttgttggtttttaattatggttacacattcatgtgtttatttttatcctgttttgttccagaaaggatttgaggtagtgtacatacatgtataggatagaagatttaataaaaacaaagtgaaatttgggaccatagggaaataaagtagaaattatacctggattcctgatttaatttctataattcataaaatatgtgcagggcattcctgagaaactgccagaagggcagctctgtgcgatgctaaaaggggcagtaagccatggcttccataatacaagaaaaataaatcaagcactcca

SEQ ID NO: 326646 - DNA, 1703 bp, Homo sapiens
ttccggcaagcctcgaggctcacggggtttatgcacactaacttcactgagccagggagcacggaagttgtgccactgtgcaacttgggttttctttatcctgcagtctttacctcagcagaaccgcacaccacagactccctccagctctttgtgtgtggctctctcagggtccaacaagagcaagctgtgggtctgtgagtgtttatgtgtgcttttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagatgcagtccccctggaaaatccttacggtggcgcctctattcttgctcctgtctcttcagtcctcggcctctccagccaacgatgaccagtccaggcccagcctctcgaatgggcacacctgtgtagggtgtgtgctggtggtgtctgtaatagaacagcttgctcaagttcacaactcgacggtccaggcctcgatggagagactgtgcagctacctgcctgaaaaactgttcttgaaaaccacctgctatttagtcattgacaagtttggatcagacatcataaaactgcttagcgcagatatgaatgctgatgtggtatgtcacactctggagttttgtaaacagaacactggccaaccattgtgtcatctctaccctcttcccaaggagacatggaaatttacactacagaaggcaagacaaattgtcaagaagtccccgattctgaaatattctagaagtggttctgacatttgttcactcccggttttggccaagatctgccagaaaattaaattagctatggaacagtctgtgccattcaaagatgtggattcagacaaatacagcgttttcccaacactgcggggctatcactggcgggggagagactgtaatgacagcgacgagtcagtgtacccaggtagaaggccgaacaactgggatgtccatcaggattcaaactgtaatggcatttggggtgtcgatccaaaagatggagttccatatgagaagaaattctgtgaaggttcacagcccaggggaatcattttgctgggagactcagctggggctcattttcacatctctcctgaatggatcacagcgtcgcagatgtctttgaactctttcatcaatctaccaacagcccttaccaacgagcttgactggccccaactctctggtgctacaggatttctggactccactgttggaattaaagaaaaatctatttaccttcgcttatggaaaagaaaccactgtaatcacagggactaccagaatatttcaagaaatggtgcatcttcccgaaacctgaagaaatttatagaaaggaagagtgacccagtcccagccatgaccactcctgagaaactctactccaacgtcatgcagactctgaagcatctaaattcccacctgcccaatggcagccatgttattttgtatggcttaccagatggaacctttctctgggataatttgcacaacagatatcatcctctcggccagctaaataaagacatgacctatgcgcagttgtactccttcctgaactgcctccaggtgagcactcactggcttgctt

SEQ ID NO: 326647 - DNA, 286 bp, Homo sapiens
ccaccgtgcccggaaattctttcaaggctaaataatatccctttgtatggacataccatattttgtttatccatttatcagttgatgaacatttgggttgttttcacttctgctattataaatatccatgagtacctctatgaacaagtttttgtgggaacatgtgttttcaatcctcctaagaatgaagtagttgagccatatggtaactcagagtttaactttttgaggaactgtcaaactgttttccaaagcagctacactattttacatttccactggcaat

SEQ ID NO: 326648 - DNA, 493 bp, Homo sapiens
ccaagatgggtaaggggaggggacaggcttgactgttcacagtggccctggccctgctgtctcaggctagtatctgcttgttggtctcaccacattctaggctcagaaactggggagcaaagtaatgaaagaaccaggctgggaggccatggggaactcatgcctggagttcagctctcagtgtgcttttgggtcaaggacgcttccctgtcttaagtcactcatgtcagagcctttgccaagagcaatgctgtgttttgttttgggggtgagggaacacccgcgggctgaggggagggttgggccatgctagagaggccgtctgttgtccttgaacctcccaaagctgggaaataagggcctgggctggacggcggtggcgaggacaggttgcgagagagacatggctgggttttcttgcttagggtcctgaatagagagcaaggttgaggccgcagggaccccagcccccaatggactgctgagtcgctgg

SEQ ID NO: 326649 - DNA, 193 bp, Homo sapiens
gaatccactgactctaggtaaaacagggcatgtcaggaagtgagtgcagtcttcccataacctcagagtagcagaaggagaaggtgggactctgaaagctggagccacgtttcctgtgaagaaagatggagtggaccttccttgcttcaggtaccagatcacaggtctcttctcagtcggggatgcctcatct

SEQ ID NO: 326650 - DNA, 243 bp, Homo sapiens
cagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccag

SEQ ID NO: 326651 - DNA, 379 bp, Homo sapiens
atgccagggttggggagagggtgcctggaaatccagtctggctctgcagctactttccatcagcagctcaagactatggaagggattaaaaaattttgttggccagttggacatctctgctacataatacagtaagcgctgtagtacagatgcatacagaagacagagacagtcaattctgccttaaaaataatgggaggttttgtagaggacctgacagcttagctgagtcatcaggtggatgacagagagaaatgtgcaaagcatagactcacgaaagagcttatcaagttattgtgctgtttgtgggggattttttttttttgccctttttccccattttttggtcaaacctcacgacctagcaagtcatttaact

SEQ ID NO: 326652 - DNA, 142 bp, Homo sapiens
aggaaggaggatagaccatagaggaactcaggagatctttgctgaatacaagcgttcaggttcagaggggacagaggattttatagctccttatcaggcattcctgccccatcatcatcttttttttttttttttttttttt

SEQ ID NO: 326653 - DNA, 2200 bp, Homo sapiens
agcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctcgtcctcctccaattcggccagcgccccctcggctgcctgcaagagcgcgggcggcggcggcgcgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcagtgggactgccccgttaccagcatcactctactccagtgtgtgacagaaaagatttcgtcctcaacttcaatgggatttcttctttccatccctcagctagcgggtcgtattatcaccatcaccaccagagcgtctgtcaggatattaagccctgcgtcatgtgaacggaaagaggccaagcgatggccgctctctcctctcccctcctcagagggggcagatagaaactgggacggattcaagtcacatgcacgcggatagcagtaagccacacacctgccacttagccagaatgcccaggatcgcgttggtcactgttatttgcctactgctggaagaaggacaaccgctggcaaggtagcgttccccaatctgaatacctgcaggctcccacatgagggagagggcagactcaggtgggaagatgtgccatgcgtaaggcatcaacgtgtatctgtgggatcttcgttgccttcagtaatcagggtgtgaaaaaagcagacaagttgtgtgtgtgtgtgtgtgtctaagaaaacttgtgtgcttttcaaaaaggcagtgctaagcacaagatttcaagaaagcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaatttttttcaataaaatgtatataacaaataaaaaaaatag

SEQ ID NO: 326654 - DNA, 5515 bp, Homo sapiens
cgcgcttccgggttggctgtggctgtggctgcggcggcggcgcaggagcagaaaccggtgcggcgcagaagccccagaggcgggcggggcggagcggagggccagcgggccccggcgtgggtctcccgccaggccgccggatttaacccttagtggcttctgaagaaaatggcagaaacatcgccagagccttctgggcagcttgttgtacactcagacgctcacagtgacactgtgctggccagttttgaggatcagaggaagaaaggcttcctctgtgacattactttaatcgtggagaatgtacatttccgggcccacaaagccttacttgctgccagtagtgaatacttctcaatgatgtttgcagaagagggggaaatcggccaatccatttatatgctggaaggcatggttgcagacacctttggtatcctgctggaatttatctacacaggttatctccatgccagtgagaaaagtacagaacaaatcctggctactgctcagttcttaaaagtctatgacctggtaaaggcttacacagacttccaaaataatcatagctccccaaagccaacaactttgaacactgctggtgccccagtggttgttatctctaataagaaaaacgatcctccaaagcggaaacggggaagaccaaaaaaagtcaatacattgcaggaggagaaatcagaactggctgcagaggaagaaatacagttaagagtgaacaattcagttcagaatagacaaaactttgtggttaaaggagacagtggtgtactgaatgagcaaattgcagcaaaagaaaaggaagaatcggagcctacttgtgagccaagtagagaggaggaaatgccagttgaaaaagatgagaactatgatcccaagaccgaggatggccaggcaagccagagtcgatacagcaagcggaggatttggagatccgtcaaacttaaagattacaaacttgttggggatcaagaggaccatggttcagccaagaggatctgtggaaggagaaagcgccctggaggccctgaggcccgctgtaaagactgtggcaaggtctttaagtacaatcactttttagcaatccaccagaggagccacacaggggagcgacctttcaaatgtaatgagtgtggaaaaggctttgcccagaagcactcgctacaggtccacaccaggatgcacacaggcgagcggccgtacacctgcaccgtgtgcagcaaggctctgaccaccaagcactcactgctggagcacatgagcctgcactcaggacagaagtcttttacctgtgatcaatgcggaaaatatttcagccagaacagacagctaaagagccattaccgagttcatacaggccactcattaccggaatgcaaagactgccatcgcaaattcatggatgtgtctcagctaaagaaacatctgcgaacacacacaggtgagaagccatttacttgtgaaatctgtggcaaatctttcacagcaaagagttctcttcagacccacatcagaatccatcgaggagaaaagccatactcctgtggcatttgtggcaaatccttctctgactccagtgccaaaaggagacactgcattctacacactggcaagaagcctttctcctgccctgagtgtaacttacagtttgctcgcttagacaacttgaaggctcacttgaaaattcatagcaaggagaagcatgcttcagatgccagcagcatttctggcagtagtaatacagaagaggtcaggaatattcttcagctacagccatatcaactctctacctcgggagagcaggaaattcagcttctcgtaaccgattctgtacataacatcaatttcatgcccggtcctagccagggaatcagcattgtgactgcagagagttcccaaaacatgactgcagaccaggctgctaatcttaccctgctcacgcagcagccagagcaactgcagaatttaattctttcagctcaacaggagcaaacagaacacattcagagcctcaatatgattgaaagccagatggggccctcacaaacagagccagtgcacgtgatcactctgtccaaggaaacactggaacatcttcatgcccatcaagagcaaacagaggagctccatttagctacaagtacttcagatccagctcagcacctgcagctgacacaggagcctggtccgccaccacccactcaccacgtgccccagccaacgccacttggccaggagcagagctgacctgtaaacacgtttgactgcttgattgggctcttcttataagccagctctgactggattttgaacgcttgaaatcaggctctccacaccattgacttgcagatgcttctgtgagagctgtgatggctaactgatgtttataatgccctccatccaggtagcaagatgtgtgtatgtcttgtctaaggtactgatttgtattgagcatttcaatattattgaatggttttcattttaatctgcaatgtctcataaagactcgggtagtttttctttgggggcattgatctcagtttttctgtaaggtttaaatgttcacagccataggttatggtcttgccaacctccccagttatgtttttttgttttctaggacaaagggagtcattttggttgaactgggcagaatggtttgttctattttcttatttttcttaggcaacacagttgttaccacaagacaagtcagggctaaatatgacagatcacaatgtatggggaatttgcccttttaataatttccagtcccctaagacaaagtaaccctcaacgttttatctttatgcagtacagtgggcttattgtgttaacacttcagaaagattcaaactcataaactcagtattttaactcaaaattcatgtaacaagatagccaaaagcataggatttcttaaaattctgaattcgtcttttctgagaaacataaatttacatatttttcaacagaaggctatcaaaattttaattaagtttaaaatacaaaattggatcaagacattcaccctaaattctgaatttttgtcagaaaagagatttgattttcatgaaggtaaagctttcttcactattctggaacataaaactttattcagtgtaatttaagtcttatatatactctactgaattctaactgatctcctgaaaatgttgatctacgtgttgtgtctgataactttctggagatggaagcttataattcatttttattgcagactagttaaatcccacaaagtgaatatcttctcctaatctttccttttttagagacagggtctcactgtatcacccaggccagagtgtagtggcacaatcattgctcactgtaacctcgaattcctgggctcaagcaaccctcccaccttagcctccctagtagctgggactacagggatgtaccaccacacccagctaatcttcatctaatcttaaaactttgagcctcagagactttgtagccagcatgtgtctgtaattgtatgatttttaaatcatcatcaaaagattaaattatgtttgggttaggttttcaagctaagcttattgaattcttttaccactttcatgtaagctggtaggggatttttgagaaaagaaggtgggcactagtatatctaaattaacaatgctgatggggagtagggggtaatctactctaaaattaatagagcctttccatcaattgttttgttttagacatccttgatttctccctaaatcaaataagttatttggaggttagagtaatagagaattcttcaggtttgagagaagataaaaacattttggttgcatatttgctaagctatattttattatatgtaattcacaaaacttccaaaatgatatatatcttatatgtatcaaccaaactaatgttaaatcaggcctgactagagcaaagataacaattttttacaaacactgttaagccctaagtattatttcaggttctcgtttaaactgtttaattttattcttaaaacacaaagtttttaccaacttttcaaagcccaccaatccacattttctccaggaaattaaatatttaagtaagtgagtgtttactcactctggatagctaggtgattattcagaaaatacggttacatagctatttataagtcaagtttcactggctctataacagtctacctctacactaagagaactataacatgaacaacataggtcactttaaatgttctagtagcaacttttaaaaacataaaaagaagcaggtgaaaatgttaataaaagtttatttaatccaacatttgccaaatatttcaacatataaaaatatattagtgagacattttacattctctttttcatactaagctttcgaaatctggtgtgtattttacactttctgcacatctccatttggatgctaatgttcattggacatacttgatctgtatttagatttcatacaacttacagttgaaaacagattctcatatcaagtagctaagacaaaagtttttttcaagaattgaaataagtatcagtttaaaaatttatattaaatttattaaaattaaaatccagttccttgttgcatgggacacagtgcaaatgcttgataagcacatgtggctagtggctgctatattggacagcatgggccacctgtttctaacttgagcatcagtcctagctatgcctgaattatttgaccagctgtcaaagagaaacaaggaaatgatagctttgttaatctagcctctttctttgtcccacatatacattctacccctttgaataaaaaagttcaatgacgccgggcgtggaggctcatgcctgtaatcccagcactttgggaggccaaggtgggcggatcacgaggtcaggagttcgagggcagcctgaccaacatagtgaaaccccatctctactaaaaatacaaaaattagctgggcgtggtggtgtacccctgtaatcccagctactcgggaggctgagacaggagaatcacttgagcccaggaggcggaggctgcagtgagctgagatcacgccattgcactcaagcctggcgacagagcgagactccgtctcaaaaaaaaaaagttaaatgacttgagtacccaaaagaaatgtcgtgaacatgaaagtacttctcatgtgtccttgagaaatgatgttgctagtgcagtgtttcacaattcattttctactaaatgtgtaccattttttaaattgttttaacagaaatatagagtgtgtttcttaggaaatagaatgttatgctttggggctcctgaaacacctcgttttgaaggtgaatctttggttttctcccagaagagggtctgccttgggatgattggagctcttaccatcaaaatcagttattcaagtgcttgcccagtgcttcttgaaactcacctctactctgtattttctacagttggttcttgtgttataaatgttgtgagcaacagattaaatgatgctgaggaatga

SEQ ID NO: 326655 - DNA, 1342 bp, Homo sapiens
cgcgcttccgggttggctgtggctgtggctgcggcggcggcgcaggagcagaaaccggtgcggcgcagaagccccagaggcgggcggggcggagcggagggccagcgggccccggcgtgggtctcccgccaggccgccggatttaacccttagtggcttctgaagaaaatggcagaaacatcgccagagccttctgggcagcttgttgtacactcagacgctcacagtgacactgtgctggccagttttgaggatcagaggaagaaaggcttcctctgtgacattactttaatcgtggagaatgtacatttccgggcccacaaagccttacttgctgccagtagtgaatacttctcaatgatgtttgcagaagagggggaaatcggccaatccatttatatgctggaaggcatggttgcagacacctttggtatcctgctggaatttatctacacaggttatctccatgccagtgagaaaagtacagaacaaatcctggctactgctcagttcttaaaagtctatgacctggtaaaggcttacacagacttccaaaataatcatagctccccaaagccaacaactttgaacactgctggtgccccagtggttgttatctctaataagaaaaacgatcctccaaagcggaaacggggaagaccaaaaaaagtcaatacattgcaggaggagaaatcagaactggctgcagaggaagaaatacagttaagagtgaacaattcagttcagaatagacaaaactttgtggttaaaggagacagtggtgtactgaatgagcaaattgcagcaaaagaaaaggaagaatcggagcctacttgtgagccaagtagagaggaggaaatgccagttgaaaaagatgagaactatgatcccaagaccgaggatggccaggcaagccagagtcgatacagcaagcggaggatttggagatccgtcaaacttaaagattacaaacttgttggggatcaagaggaccatggttcagccaagaggatctgtggaaggagaaagcgccctggaggccctgaggcccgctgtaaagactgtggcaaggtctttaagtacaatcactttttagcaatccaccagaggagccacacaggtaatgatgttttcaaagctgattgcagtgtgttgcagaattgggagtagtgatgataataatagcttccatttactgtgcaacttctgtgtgatgggcattgtaataaagcctttatacatgttattgcagttaattttctccacaatcctgcaaggtgggtaatatcctcattatacattgtatgattaaaatcatatttactcatatgtaagagagggt

SEQ ID NO: 326656 - DNA, 5598 bp, Homo sapiens
cgcgcttccgggttggctgtggctgtggctgcggcggcggcgcaggagcagaaaccggtgcggcgcagaagccccagaggcgggcggggcggagcggagggccagcgggccccggcgtgggtctcccgccaggccgccggatttaacccttagtggcttctgaagaaaatggcagaaacatcgccagagccttctgggcagcttgttgtacactcagacgctcacagtgacactgtgctggccagttttgaggatcagaggaagaaaggcttcctctgtgacattactttaatcgtggagaatgtacatttccgggcccacaaagccttacttgctgccagtagtgaatacttctcaatgatgtttgcagaagagggggaaatcggccaatccatttatatgctggaaggcatggttgcagacacctttggtatcctgctggaatttatctacacaggttatctccatgccagtgagaaaagtacagaacaaatcctggctactgctcagttcttaaaagtctatgacctggtaaaggcttacacagacttccaaaataatcatagctccccaaagccaacaactttgaacactgctggtgccccagtggttgttatctctaataagaaaaacgatcctccaaagcggaaacggggaagaccaaaaaaagtcaatacattgcaggaggagaaatcagaactggctgcagaggaagaaatacagttaagagtgaacaattcagttcagaatagacaaaactttgtggttaaaggagacagtggtgtactgaatgagcaaattgcagcaaaagaaaaggaagaatcggagcctacttgtgagccaagtagagaggaggaaatgccagttgaaaaagatgagaactatgatcccaagaccgaggatggccaggcaagccagagtcgatacagcaagcggaggatttggagatccgtcaaacttaaagattacaaacttgttggggatcaagaggaccatggttcagccaagaggatctgtggaaggagaaagcgccctggaggccctgaggcccgctgtaaagactgtggcaaggtctttaagtacaatcactttttagcaatccaccagaggagccacacaggggagcgacctttcaaatgtaatgagtgtggaaaaggctttgcccagaagcactcgctacaggtccacaccaggatgcacacaggcgagcggccgtacacctgcaccgtgtgcagcaaggctctgaccaccaagcactcactgctggagcacatgagcctgcactcaggacagaagtcttttacctgtgatcaatgcggaaaatatttcagccagaacagacagctaaagagccattaccgagttcatacaggccactcattaccggaatgcaaagactgccatcgcaaattcatggatgtgtctcagctaaagaaacatctgcgaacacacacaggtgagaagccatttacttgtgaaatctgtggcaaatctttcacagcaaagagttctcttcagacccacatcagaatccatcgaggagaaaagccatactcctgtggcatttgtggcaaatccttctctgactccagtgccaaaaggagacactgcattctacacactggcaagaagcctttctcctgccctgagtgtaacttacagtttgctcgcttagacaacttgaaggctcacttgaaaattcatagcaaggagaagcatgcttcagatgccagcagcatttctggcagtagtaatacagaagaggtcaggaatattcttcagctacagccatatcaactctctacctcgggagagcaggaaattcagcttctcgtaaccgattctgtacataacatcaatttcatgcccggtcctagccagggaatcagcattgtgactgcagagagttcccaaaacatgactgcagaccaggctgctaatcttaccctgctcacgcagcagccagagcaactgcagaatttaattctttcagctcaacaggagcaaacagaacacattcagagcctcaatatgattgaaagccagatggggccctcacaaacagagccagtgcacgtgatcactctgtccaaggaaacactggaacatcttcatgcccatcaagagcaaacagaggagctccatttagctacaagtacttcagatccagctcagcacctgcagctgacacaggagcctggtccgccaccacccactcaccacgtgccccagccaacgccacttggccaggagcagagctgacctgtaaacacgtttgactgcttgattgggctcttcttataagccagctctgactggattttgaacgcttgaaatcaggctctccacaccattgacttgcagatgcttctgtgagagctgtgatggctaactgatgtttataatgccctccatccaggtagcaagatgtgtgtatgtcttgtctaaggtactgatttgtattgagcatttcaatattattgaatggttttcattttaatctgcaatgtctcataaagactcgggtagtttttctttgggggcattgatctcagtttttctgtaaggtttaaatgttcacagccataggttatggtcttgccaacctccccagttatgtttttttgttttctaggacaaagggagtcattttggttgaactgggcagaatggtttgttctattttcttatttttcttaggcaacacagttgttaccacaagacaagtcagggctaaatatgacagatcacaatgtatggggaatttgcccttttaataatttccagtcccctaagacaaagtaaccctcaacgttttatctttatgcagtacagtgggcttattgtgttaacacttcagaaagattcaaactcataaactcagtattttaactcaaaattcatgtaacaagatagccaaaagcataggatttcttaaaattctgaattcgtcttttctgagaaacataaatttacatatttttcaacagaaggctatcaaaattttaattaagtttaaaatacaaaattggatcaagacattcaccctaaattctgaatttttgtcagaaaagagatttgattttcatgaaggtaaagctttcttcactattctggaacataaaactttattcagtgtaatttaagtcttatatatactctactgaattctaactgatctcctgaaaatgttgatctacgtgttgtgtctgataactttctggagatggaagcttataattcatttttattgcagactagttaaatcccacaaagtgaatatcttctcctaatctttccttttttagagacagggtctcactgtatcacccaggccagagtgtagtggcacaatcattgctcactgtaacctcgaattcctgggctcaagcaaccctcccaccttagcctccctagtagctgggactacagggatgtaccaccacacccagctaatcttcatctaatcttaaaactttgagcctcagagactttgtagccagcatgtgtctgtaattgtatgatttttaaatcatcatcaaaagattaaattatgtttgggttaggttttcaagctaagcttattgaattcttttaccactttcatgtaagctggtaggggatttttgagaaaagaaggtgggcactagtatatctaaattaacaatgctgatggggagtagggggtaatctactctaaaattaatagagcctttccatcaattgttttgttttagacatccttgatttctccctaaatcaaataagttatttggaggttagagtaatagagaattcttcaggtttgagagaagataaaaacattttggttgcatatttgctaagctatattttattatatgtaattcacaaaacttccaaaatgatatatatcttatatgtatcaaccaaactaatgttaaatcaggcctgactagagcaaagataacaattttttacaaacactgttaagccctaagtattatttcaggttctcgtttaaactgtttaattttattcttaaaacacaaagtttttaccaacttttcaaagcccaccaatccacattttctccaggaaattaaatatttaagtaagtgagtgtttactcactctggatagctaggtgattattcagaaaatacggttacatagctatttataagtcaagtttcactggctctataacagtctacctctacactaagagaactataacatgaacaacataggtcactttaaatgttctagtagcaacttttaaaaacataaaaagaagcaggtgaaaatgttaataaaagtttatttaatccaacatttgccaaatatttcaacatataaaaatatattagtgagacattttacattctctttttcatactaagctttcgaaatctggtgtgtattttacactttctgcacatctccatttggatgctaatgttcattggacatacttgatctgtatttagatttcatacaacttacagttgaaaacagattctcatatcaagtagctaagacaaaagtttttttcaagaattgaaataagtatcagtttaaaaatttatattaaatttattaaaattaaaatccagttccttgttgcatgggacacagtgcaaatgcttgataagcacatgtggctagtggctgctatattggacagcatgggccacctgtttctaacttgagcatcagtcctagctatgcctgaattatttgaccagctgtcaaagagaaacaaggaaatgatagctttgttaatctagcctctttctttgtcccacatatacattctacccctttgaataaaaaagttcaatgacgccgggcgtggaggctcatgcctgtaatcccagcactttgggaggccaaggtgggcggatcacgaggtcaggagttcgagggcagcctgaccaacatagtgaaaccccatctctactaaaaatacaaaaattagctgggcgtggtggtgtacccctgtaatcccagctactcgggaggctgagacaggagaatcacttgagcccaggaggcggaggctgcagtgagctgagatcacgccattgcactcaagcctggcgacagagcgagactccgtctcaaaaaaaaaaagttaaatgacttgagtacccaaaagaaatgtcgtgaacatgaaagtacttctcatgtgtccttgagaaatgatgttgctagtgcagtgtttcacaattcattttctactaaatgtgtaccattttttaaattgttttaacagaaatatagagtgtgtttcttaggaaatagaatgttatgctttggggctcctgaaacacctcgttttgaaggtgaatctttggttttctcccagaagagggtctgccttgggatgattggagctcttaccatcaaaatcagttattcaagtgcttgcccagtgcttcttgaaactcacctctactctgtattttctacagttggttcttgtgttataaatgttgtgagcaacagattaaatgatgctgaggaatgaaaaaagattctcattataaatgcttacctaggattctcattatagatgcttatctaggttttcataaatgggaatgtaacaat

SEQ ID NO: 326657 - DNA, 4647 bp, Homo sapiens
gcctgggtgatagagtgagaccctgttacaaaggaaaaacaaaaaattaggttatgttagtgctactcactgctggcttcagattcatctgttcagcttccaaaattttattgctgatgtctcttgtgttcattgttggccttttggatgtgtgccttttaagaaaaatcctttattgtttttttaatttgggagagacagaaaaatgtgtggattcttacttataccatgcttctggggctcttcttccaggggagcgacctttcaaatgtaatgagtgtggaaaaggctttgcccagaagcactcgctacaggtccacaccaggatgcacacaggcgagcggccgtacacctgcaccgtgtgcagcaaggctctgaccaccaagcactcactgctggagcacatgagcctgcactcaggacagaagtcttttacctgtgatcaatgcggaaaatatttcagccagaacagacagctaaagagccattaccgagttcatacaggccactcattaccggaatgcaaagactgccatcgcaaattcatggatgtgtctcagctaaagaaacatctgcgaacacacacaggtgagaagccatttacttgtgaaatctgtggcaaatctttcacagcaaagagttctcttcagacccacatcagaatccatcgaggagaaaagccatactcctgtggcatttgtggcaaatccttctctgactccagtgccaaaaggagacactgcattctacacactggcaagaagcctttctcctgccctgagtgtaacttacagtttgctcgcttagacaacttgaaggctcacttgaaaattcatagcaaggagaagcatgcttcagatgccagcagcatttctggcagtagtaatacagaagaggtcaggaatattcttcagctacagccatatcaactctctacctcgggagagcaggaaattcagcttctcgtaaccgattctgtacataacatcaatttcatgcccggtcctagccagggaatcagcattgtgactgcagagagttcccaaaacatgactgcagaccaggctgctaatcttaccctgctcacgcagcagccagagcaactgcagaatttaattctttcagctcaacaggagcaaacagaacacattcagagcctcaatatgattgaaagccagatggggccctcacaaacagagccagtgcacgtgatcactctgtccaaggaaacactggaacatcttcatgcccatcaagagcaaacagaggagctccatttagctacaagtacttcagatccagctcagcacctgcagctgacacaggagcctggtccgccaccacccactcaccacgtgccccagccaacgccacttggccaggagcagagctgacctgtaaacacgtttgactgcttgattgggctcttcttataagccagctctgactggattttgaacgcttgaaatcaggctctccacaccattgacttgcagatgcttctgtgagagctgtgatggctaactgatgtttataatgccctccatccaggtagcaagatgtgtgtatgtcttgtctaaggtactgatttgtattgagcatttcaatattattgaatggttttcattttaatctgcaatgtctcataaagactcgggtagtttttctttgggggcattgatctcagtttttctgtaaggtttaaatgttcacagccataggttatggtcttgccaacctccccagttatgtttttttgttttctaggacaaagggagtcattttggttgaactgggcagaatggtttgttctattttcttatttttcttaggcaacacagttgttaccacaagacaagtcagggctaaatatgacagatcacaatgtatggggaatttgcccttttaataatttccagtcccctaagacaaagtaaccctcaacgttttatctttatgcagtacagtgggcttattgtgttaacacttcagaaagattcaaactcataaactcagtattttaactcaaaattcatgtaacaagatagccaaaagcataggatttcttaaaattctgaattcgtcttttctgagaaacataaatttacatatttttcaacagaaggctatcaaaattttaattaagtttaaaatacaaaattggatcaagacattcaccctaaattctgaatttttgtcagaaaagagatttgattttcatgaaggtaaagctttcttcactattctggaacataaaactttattcagtgtaatttaagtcttatatatactctactgaattctaactgatctcctgaaaatgttgatctacgtgttgtgtctgataactttctggagatggaagcttataattcatttttattgcagactagttaaatcccacaaagtgaatatcttctcctaatctttccttttttagagacagggtctcactgtatcacccaggccagagtgtagtggcacaatcattgctcactgtaacctcgaattcctgggctcaagcaaccctcccaccttagcctccctagtagctgggactacagggatgtaccaccacacccagctaatcttcatctaatcttaaaactttgagcctcagagactttgtagccagcatgtgtctgtaattgtatgatttttaaatcatcatcaaaagattaaattatgtttgggttaggttttcaagctaagcttattgaattcttttaccactttcatgtaagctggtaggggatttttgagaaaagaaggtgggcactagtatatctaaattaacaatgctgatggggagtagggggtaatctactctaaaattaatagagcctttccatcaattgttttgttttagacatccttgatttctccctaaatcaaataagttatttggaggttagagtaatagagaattcttcaggtttgagagaagataaaaacattttggttgcatatttgctaagctatattttattatatgtaattcacaaaacttccaaaatgatatatatcttatatgtatcaaccaaactaatgttaaatcaggcctgactagagcaaagataacaattttttacaaacactgttaagccctaagtattatttcaggttctcgtttaaactgtttaattttattcttaaaacacaaagtttttaccaacttttcaaagcccaccaatccacattttctccaggaaattaaatatttaagtaagtgagtgtttactcactctggatagctaggtgattattcagaaaatacggttacatagctatttataagtcaagtttcactggctctataacagtctacctctacactaagagaactataacatgaacaacataggtcactttaaatgttctagtagcaacttttaaaaacataaaaagaagcaggtgaaaatgttaataaaagtttatttaatccaacatttgccaaatatttcaacatataaaaatatattagtgagacattttacattctctttttcatactaagctttcgaaatctggtgtgtattttacactttctgcacatctccatttggatgctaatgttcattggacatacttgatctgtatttagatttcatacaacttacagttgaaaacagattctcatatcaagtagctaagacaaaagtttttttcaagaattgaaataagtatcagtttaaaaatttatattaaatttattaaaattaaaatccagttccttgttgcatgggacacagtgcaaatgcttgataagcacatgtggctagtggctgctatattggacagcatgggccacctgtttctaacttgagcatcagtcctagctatgcctgaattatttgaccagctgtcaaagagaaacaaggaaatgatagctttgttaatctagcctctttctttgtcccacatatacattctacccctttgaataaaaaagttcaatgacgccgggcgtggaggctcatgcctgtaatcccagcactttgggaggccaaggtgggcggatcacgaggtcaggagttcgagggcagcctgaccaacatagtgaaaccccatctctactaaaaatacaaaaattagctgggcgtggtggtgtacccctgtaatcccagctactcgggaggctgagacaggagaatcacttgagcccaggaggcggaggctgcagtgagctgagatcacgccattgcactcaagcctggcgacagagcgagactccgtctcaaaaaaaaaaagttaaatgacttgagtacccaaaagaaatgtcgtgaacatgaaagtacttctcatgtgtccttgagaaatgatgttgctagtgcagtgtttcacaattcattttctactaaatgtgtaccattttttaaattgttttaacagaaatatagagtgtgtttcttaggaaatagaatgttatgctttggggctcctgaaacacctcgttttgaaggtgaatctttggttttctcccagaagagggtctgccttgggatgattggagctcttaccatcaaaatcagttattcaagtgcttgcccagtgcttcttgaaactcacctctactctgtattttctacagttggttcttgtgttataaatgttgtgagcaacagattaaatgatgctgaggaatga

SEQ ID NO: 326658 - DNA, 275 bp, Homo sapiens
gtgctgccttccatctgcttcaaagcattttttggatccatcattattcagtgaaatgccccttggcattctttggtgctgagcaagaagctgcatgcaaagcaataccaaaacgattgcctaaacctactgcccttcaccatgaaacttagcctttgtcctcaagcatcactacaccctccccaaacaagggttggagaaatgaaagtttatagtaaaaggcaatgttctgcctcccacaaaattgcacactaaagggtagcatggacatgctg

SEQ ID NO: 326659 - DNA, 1027 bp, Homo sapiens
gggattacaggcattagccaccatgcctggccaaaataaatgactttcaaaaaaactgcacatatttatttttatttatatttatttatttatttgagacagagtctggctctgtcgcccaggctggagtgcagtagcacaatctcagctcactgcaagctccgcctcctgggttcatgccattctcctgcctcagcctcctgagtagctgggactataggcgcccacagccacgcccggctaatttttctatttttagtagagacagggtttcaccgtgttagccaggatggtctcgatctcctggccatgtgatccgcctgcctcggcctcccaaagtgctgggattacaggcatgagcccccgtgcctggccaaaactgcacatatttaaactgtaaagtgtgataagttttgacattaataagcctgtaatatgatccatcaccttcatatttacctggagtctggtaacgtctttacctctgccttccagatgaccattgataactttgctttataatagattattttacattttctacatttttatacgtgatttgatgtcgtgaagtgtttaatctttatccctggatggtatcgtgcggtatatttattttgagatttgtcagtgatgatacttgagtagttcactcctttttatattgctgagatgacatgctatgaaatatcactgtatattcattcatctgtttatacatcattaatctatttctcatttttggcttccataaataaaactacagacactttagtacagttctttatgtaaatatgtttcttttttatgtgttactatctgggggttcaataactgaatcagaataggtaaatctatagctttttgtttgtttgtctgttttgagatggagtctcgctctgtcactcaggctggagtgcagtgatgcaatctcggctcactgcaacctccacctcccaggttaaagtgattcttgtgcctcagctacttcggagggtgagccaggaaaattgctgaccacgcaggg

SEQ ID NO: 326660 - DNA, 621 bp, Homo sapiens
cccaacttctatccgctataaaaatgtagaaaatgtaaaataatctattataaagcaaagttatcaatggtcatctggaaggcagaggtaaagacgttaccagactccaggtaaatatgaaggtgatggatcatattacaggcttattaatgtcaaaacttatcacactttacagtttaaatatgtgcagttttggccaggcatcgtggcattcgcctataatcccagctacttgggaggctgaggcacaagaatcactttaacctgggaggtggaggctgcagtgagctcaggtaatgccaccccataccaggatgagcaacaagagcgaaactatctcaaaaataccataattttggggttcataggtcaacctgaaagggtggcagttttcatcacaatctctggtgcttctgagagcaacatgaaattgttctctacttcacaagggatggtgcattatgtttcagtgctgttgagggtaccttcacaggttgtgaggttatagtggaaatgataagtttttcggaattactgcattttaaaagggcttctactatgatccagacatggctgtgaaggatgaatacaaacagaaattctcaggaccttcttaattga

SEQ ID NO: 326661 - DNA, 602 bp, Homo sapiens
gccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagacgtggctgtaaacttttccctggaggaatggagtcttcttaatgaggctcagggatgcctgtaccatgatgtgatgctggagaccttgacacttatatcctccctgaaagggtgcactcgccagcagttttgcaacaggagcacactgaacaaagaagacagggtcatttataacctgaggcgttcaccctcctgccggtttccattgcctggaacaggacctcatattctgtatgtgtcctgattggctagcaacttagaaccttttaagaggcaaaggtagaggagaacaaagaaaggaggaagtaacttgtggaatgctgagaaaggtaaaaacacttttaaataaggaagaggaacaggctatgac

SEQ ID NO: 326662 - DNA, 2098 bp, Homo sapiens
aaggttccacaggcaagttgtttgcaaatgaaggagttatagaccctgcctttattctgtctgttgactcatttagtcatgcccttgacaatatgaggccttctatatctgtgataatgctaagcagccccaacctcaacctgaacccaactccctgtttgtgcaaataattccatagactagttttttggtttgtcagatactcttgtgggtaggctgcatactcaacaaagtcaacatgtacctcaccagcatttctttgcttttaggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccctgatttgtgttataataaaggccttgttgcttaaga

SEQ ID NO: 326663 - DNA, 931 bp, Homo sapiens
cctgggagaaggaggatgggcaagggtagatatgttggggaagtggattgtgggtcttcagcacaggggccatttatggtttcatctatccccatcataacagagcagtgtgacctttgaagacgtggctgtaaacttttccctggaggaatggagtcttcttaatgaggctcagggatgcctgtaccatgatgtgatgctggagaccttgacacttatatcctccctggtaaggtactcatacttaactgtgacctgagttagtctctgcccctcccctttattcctcttggtaataacgtctttctcacatcaggactgtggcacagcttcattctccaattctctggatcagttctgtggttggtagtactgagatacatgtactgccctctcctttccttgagcagccccagtctgctttgttgcaggctcccagggaaagagttagggtcaggagtcttaaagtcaccctaatgcatcccaccttggttgtcttctgcctttctgggtgactgtgcagatctaagacttctttttttgagacggagtctcgctctgtcgcccaggctggagtgcagtggcgcagtctcggctcactgcaagctctgcctcccgggctcacgccattctcctgcctcagcctcccgagtagctgggattacaggcgcctgctaccacactgttctgtgtgggaaacatgcaaggggagaagaaaagacaaacatacacaatccctttaatggtaaacaacctttaacccacgtaaatggcaatgcagatataataagcaaataatataagcaaatggatataataagcaaattgcaatggggaggggataagggaaaagatacatatatatttatactcaccagactatggaggattcaccaccagactggcaagcaacagcctgggctccagagtc

SEQ ID NO: 326664 - DNA, 997 bp, Homo sapiens
gccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagatgtggctgtaaacttttccctggaggaatggagtcttcttaatgaggctcagagatgcctgtaccgtgacgtgatgctggagaccttgacacttatatcctccctggagcagtgtgacctttgaagacgtggctgtaaacttttccctggaggaatggagtcttcttaatgaggctcagggatgcctgtaccatgatgtgatgctggagaccttgacacttatatcctccctgatgaccattgataactttgctttataatagattattttacattttctacatttttatacgtgatttgatgtcgtgaagtgtttaatctttatccctggatggtatcgtgcggtatatttattttgagatttgtcagtgatgatacttgagtagttcactcctttttatattgctgagatgacatgctatgaaatatcactgtatattcattcatctgtttatacatcattaatctatttctcatttttggcttccataaataaaactacagacactttagtacagttctttatgtaaatatgtttcttttttatgtgttactatctgggggttcaataactgaatcagaataggtaaatctatagctttttgtttgtttgtctgttttgagatggagtctcgctctgtcactcaggctggagtgcagtgatgcaatctcggctcactgcaacctccacctcccaggttaaagtgattcttgtgcctcagctacttcggagggtgagccaggaaaattgctgaccacgcaggg

SEQ ID NO: 326665 - DNA, 462 bp, Homo sapiens
gccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagatgtggctgtaaacttttccctggaggaatggagtcttcttaatgaggctcagagatgcctgtaccgtgacgtgatgctggagaccttgacacttatatcctccctgggtaaggtactcatattcacctgtgacctgagttagtctgtgcccctcacctttatgccttatctctttctcacaccaggaccatggacacagcttcattctccagttctctggagaggttctg

SEQ ID NO: 326666 - DNA, 2168 bp, Homo sapiens
gccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagatgtggctgtaaacttttccctggaggaatggagtcttcttaatgaggctcagagatgcctgtaccgtgacgtgatgctggagaccttgacacttatatcctccctgggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccctgatttgtgttataataaaggccttgttgcttaaga

SEQ ID NO: 326667 - DNA, 2214 bp, Homo sapiens
gccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagatgtggctgtaaacttttccctggaggaatggagtcttcttaatgaggctcagagatgcctgtaccgtgacgtgatgctggagaccttgacacttatatcctccctgggttgttggcatggaggggaagatgaggcagcaccttctaagcagagcacgtgtatacatatatacaaagaccagggaggtcatagtggagaaaggccttatgagtgtggggaatataggaaattatttaagaacaagtcctgcctcactgaacccagaagagatcacaaacacaggaatgttcgcactggagaaaggccttatgagtgcagcaaatatgggaaattatttcaccaaaagcctacactccatattcatgagagatttcatactgggcaaaagacctatgagtgcagtgagtgtggaaaatcatttcaccaaagctcttcactcttgcagcgtcagacacttcacactagagaaaggccttatgagtgtattgaatgtgggaaagcctttgctgaaaagtccagtctcattaaccacaggaaagttcactctggagcaaagcgttatgaatgcaatgaatgtgggaagtcctttgcttatacatctagtctcattaaacacaggaggattcacactggagagaggccttatgagtgcagtgaatgtgggagatcctttgctgaaaactccagtcttattaaacacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaaggtccaacctcattcaccatcagcgagttcatactggagaaaggcatgagtgcgggcagtgtgggaaatcctttagccgaaaatctagccttattatacatctgagagttcacactggagaaaggccttatgagtgcagtgactgtgggaaatcctttgctgaaaactccagccttattaaacacttgagagttcacactggagaaaggccatatgaatgcattgattgtggaaaatcatttcgccacagttcttcgttccgtcgccatcagagagttcatactggaatgaggccttataagtgaagcaaattttggaaattctcttgcccaggctttttgctccttcaaggccagagagttcacaccagatcaaggtgttatgagtgtgacaaatggggaatattctttagctagaatgctagcttctttacataaaagagtgctcccactgaagaagtgccttttgagtgcaatgaatgtgagaaagccttcagccctctctcattggttaccacaatatttacatgaggaaaataccacagatgtggaggtaatattattttttcttcaatataacactggaggaaaccccttatgaggatgccatctgcctaaattgaatgtcatacatcaaatagctgcatacattccaggtatgtgggaactgcatagtatttttcgacctgcccaggtctcttgctagacttctgtgacttacagttctcttctaaaaagcatttcacctttaccacttggcaggtgcccacagtacatcattcgcctaactcatcatgatccagaagtaactttgattttgtttcattcaacagagggattttttagtatcctcagcactcattctattctcatttctttctctccaatgagttaggccatgaacctgactcatttttggcacagaggactcttctgataacttgaaaaaatggactacctttttcagggatcttttggatctcacagagttcttaagatggaattttccagcctgccagtcatgaatctcagacagcctgccacctattgccctgatttgtgttataataaaggccttgttgcttaagacaccttcagtctttgcaggagggcatggaagctccaagtgcttttc

SEQ ID NO: 326668 - DNA, 1184 bp, Homo sapiens
gccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcagagcagtgtgacctttgaagacgtggctgtaaacttttccctggaggaatggagtcttcttaatgaggctcagggatgcctgtaccatgatgtgatgctggagaccttgacacttatatcctccctgtagagatggggtttcactgtgttagccaggatggtctcgatctcctgacctcgtgatccacctgcctcagcctcccaaaatgctgggattataggcgtgagccaccgtgcccggccctcacagcattcttaagatagaattttccagcctgccagtcacaaatcagacagcctgcctgccgcctatttcccttgtttgtattataataaagtctctgctgcttaagacaccttcaatcttgagagctgtatttacagtgtggaattgtttgaacactggatttgcagatgggcatggtggctcatgcctgtgataccagcactttgggaggccgaggcagaagggtcagttgaggtcaggagttccagaccagcctggccaacatgctgaaaccccatctctactaaaaatacaaaattagccaggcatcgtggcattcgcctataatcccagctacttgggaggctgaggcacaagaatcactttaacctgggaggtggaggctgcagtgagctcaggtaatgccaccccataccaggatgagcaacaagagcgaaactatctcaaaaataccataattttggggttcataggtcaacctgaaagggtggcagttttcatcacaatctctggtgcttctgagagcaacatgaaattgttctctacttcacaagggatggtgcattatgtttcagtgctgttgagggtaccttcacaggttgtgaggttatagtggaaatgataagtttttcggaattactgcattttaaaagggcttctactatgatccagacatggctgtgaaggatgaatacaaacagaaattctcaggaccttcttaattga

SEQ ID NO: 326669 - DNA, 343 bp, Homo sapiens
atacatgtttgtagtggttgttaacttcaccctagacaagcagccaataagtctaggtagagcagagtaaggcggggaactatgccgtgaccgtgtgtgatacaatttttctagcctgtggtgctttttgcggcagggcttaggagtaaggttagtatgttatcatttgggaaaccaaattattattttgggtcttcagtcaattatgatgctgtgtatatttagtgtttatctacaatatatgcacattcattaatttggagctactcatcctataataaatagttgtgcatttactcccatttttttctgcatttctctccttatttataattatgtgtta

SEQ ID NO: 326670 - DNA, 299 bp, Homo sapiens
gccggaagtgggaacaaagatgggttagaggagacacgggcataaggatgagtctaaattcttcagggccagaggtgcaggagacctttcctacctccctggaatactcaactctccttacttgcctcctgtacctctggctattaattttctgtctctttcagaagcttcagttttcctcagttcattctttaaatcagcaatttaaaaaataagtttttgaatgcataatgcatgtatgtagcacaatattcaaaagctataagggcaaagtggaaaaaatcctattcccgatagct

SEQ ID NO: 326671 - DNA, 1776 bp, Homo sapiens
ggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaagatattaaaatgcatgctgtggtgaaaaagttatgcttaattgacaaaataattgagtatttaaatgaatgtgtgagtcaagatggcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtttttacaggtgcttcctgcttgcactgaagatgagaaactgctaatagatatcatacattttttaaataaattaataaag

SEQ ID NO: 326672 - DNA, 1496 bp, Homo sapiens
ggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaagatattaaaatgcatgctgtggtgaaaaagttatgcttaattgacaaaataattgagtatttaaatgaatgtgtgagtcaagatggcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtttttacaggtgcttcctgcttgcactgaagatgagaaactgctaatagatatcatacattttttaaataaattaataaaggaacaaagaaaaaattcttcactagaacttctaaactggattctcgaattacttcttagacatagtgcaaacccactgttagacctcttggttctgacagagtcacaggcacgagaagaaacagatgatatccggactgctgtcaggca

SEQ ID NO: 326673 - DNA, 1925 bp, Homo sapiens
ggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaagatattaaaatgcatgctgtggtgaaaaagttatgcttaattgacaaaataattgagtatttaaatgaatgtgtgagtcaagatggcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacaggtttttacaggtgcttcctgcttgcactgaagatgagaaactgctaatagatatcatacattttttaaataaattaataaaggaacaaagaaaaaattcttcactagaacttctaaactggattctcgaattacttcttagacatagtgcaaacccactgttagacctcttggttctgacagagtcacaggcacgagaagaaacagatgatatccggactgctgtcaggca

SEQ ID NO: 326674 - DNA, 1233 bp, Homo sapiens
ggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaagatattaaaatgcatgctgtggtgaaaaagttatgcttaattgacaaaataattgagtatttaaatgaatgtgtgagtcaagatggcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgcactcatcgatctgtgtattgtggaaggagattcaccctatagaccttctttccttctt

SEQ ID NO: 326675 - DNA, 430 bp, Homo sapiens
ttctgacacagaagagatgcttccgtgtactacccgattaaagtccatgctgcgacttttgctagtgaaaaagccatcgtgagtacaacgtaatcttgtgaacgtcaaagattgatggaaacatgctaagaaagtatagtaactatatataatttgaaacaaaactaaagaatttttaaggagggtgttattccattactagaggaaaccaatgcgtgaaactaagcagatacaaggtcttgtatgtacttgctgacgtttcatccactttacagccaagttattccttgccagatcagcctgtgttacaggactgctactaagtgccgctcagtagtgccctaggcaagttggagagccatggagataaatagatggtaaaaattatagtgcattcccatcttctctttagaaattgttagccttccag

SEQ ID NO: 326676 - DNA, 2333 bp, Homo sapiens
ggagagaagaatctcttagaattagtggagctggcagaccaagccttgcgtagcttttcctatcatcagcatttcccgctaataaaggaaatcatcagcatttgttcaaagatctggaaatctgctcaggccagtccattactacaaggagaaagtcagaaggtgcttctccatatgttgtctcacccattgccacgagtgaaagctgaaacttaccactgctgtctggaaatcacgaaggaatgtttaggtgtccataatgtcactaaacccgtgtcttcactttgcaatggaattcattttctacttcatccaaaagttctgtatgaaatctctgtatttggcattcaagagcccgaaagtgaggtgaacactgctgccaaggccattctgttatacctgcttcagggacgattgatgatgacagcattgacctggaacaagtttattgaatctctctgtcctgtcatcccaatactacagggctatgccgacacagaagatcctctgggtaactgcattctccttctaagcaaagcaagttctgacacagaagagatgcttccgtgtactacccgattaaagtccatgctgcgacttttgctagtgaaaaagccatcggtccgttcgctagcattaaagcttttagcattccatcttaccagtgaagaaggggctgatacaaagcgtcctctaatagacgccagagttctctccagagttactgatttattcattgggaagaaacctattgaactcagactggatgacagaagagagctggttattaagttggagactgttgaaaaggtatatgaaatcttcacctcagatgatgttgatctcgttttgagaaagtcagctgctgaacagttagctgtgattatgcaagatattaaaatgcatgctgtggtgaaaaagttatgcttaattgacaaaataattgagtatttaaatgaatgtgtgagtcaagatggcaaggttgtagaatgtttggtacaaccatgcctcacactcttgaggaaggttttatgtggtgatccagtcatgcgtgtttcgctctcgcaacagtcttctcttttgaccgtgttattcagagtttccttaatatttcatgaagattgtagtgtcgtgactgaagttggagcactattttgtcttctattatttgatgaagtatcgagaatggatatgtggtctgttaatccttccaataaaccttctttgccatcggtcttcagtttgcctgtttccgtttttagaaggtaccatctacctgttcatgtaattggacaccatgctgtgagtccttactccatagttttgcccttatctgctgattgtttggccttgaagccggtgtcagatatgctgagaatagcttggaacctgtcatggtatcatgggagtgataatctgttgaagcaaatgaactctgaaactaaaacgcaagaaattttagatgcattgaagttatctacagaggacatcctcactctgaagataacacacatggctagtgggctgcaggactgcctccattccattgttcaggctgcaacccacagggaagttagggctgctgtcaccaggatgagtttttatcttctgaatgacagattgtctttaaagggttgccctggtccatgtggggttaccttgaagtccttggcttggcacaccgcactaaacagtaaacatggaaaggaacaagcggtaccagccactgcaaaaacatgccaacttgtaaagaccattgatgctaggaagaaactgtatcaactaacgagcaaaataaccagctaacatcatgatgacaggattgaattcacacataacaatattaaccttaaatgtaaatggtctaaatgctccaattaaaagatacagactgggaagttggataaagagtcaagacccatcagtgtgctatattcaggagactcatctcacgtgcagagacatacataggctcaaaataaagggatggaggaagatcaaccaagcaaatggaaaacaaaaaaaggcaggggttgcaatcctctctccgataaaacagactttaaaccaacaaagatctaaagagacaaggccattacataatggtaaagggatcagttcaagaagaagagctaactatcctaaatatatatgcacccagtacaggagcacccagattcataaagcaagtccttagagacctacaaagagacttggactccacacaataataatgggagactttaacaccccactgtcaacattagacagatcagtgagacagaaagttaacaaggatatccaggacttgaactcagctctgcaccaagtgg

SEQ ID NO: 326677 - DNA, 146 bp, Homo sapiens
catgtctgtgagtagccactgcactccagcctgggcaacacagcaagactccatctctttaaaaaaaagagaaagagaaagaaaagaggagagggaagaaagaaaagaaaaaagaaaggaaaagaaaagaggagagggaagaaaga

SEQ ID NO: 326678 - DNA, 353 bp, Homo sapiens
  misc_feature (285)..(285): n is a, c, g, or t
ttccaatttgagccgctgtgaaaaaggcctccaccagcctctcaccagaagagattgctcattggaacgcaatgccacctggtgggggacgaggacagtgcgagcaagcagatgttatttcctactgacctaatttagagaacattaaacagtggaagtttccagagaaaacagccatcaaagaaggttgagagtgagaattaagagacactggagaagatcaagagaatgtgccctgaagacaacaacaaaaatcaataaaagatttcaagaatgaaatcccgnaatgcgggccggaaaacatattattgctttttaaactgactagcgagagttttgttaataatagaaat

SEQ ID NO: 326679 - DNA, 2302 bp, Homo sapiens
  misc_feature (291)..(291): n is a, c, g, or t
  misc_feature (302)..(302): n is a, c, g, or t
  misc_feature (539)..(539): n is a, c, g, or t
  misc_feature (677)..(677): n is a, c, g, or t
  misc_feature (1108)..(1108): n is a, c, g, or t
  misc_feature (2110)..(2110): n is a, c, g, or t
ttccaatttgagccgctgtgaaaaaggcctccaccagcctctcaccagaagagattgctcattggaacgcaatgccacctggtgggggacgaggacagtgcgagcaagcagatgttatttcctactgacctaatttagagaacattaaacgtaagagagggaacatttggggttggaagcctgtgcccaaaaccttaaagagtgcaggcagctggccataaaagcagcttgagcaaacccctcattcagccgttgaaatgtgtgtgtgaacactttaaaggtttcctctgngcttttcctgngtgcatttggtcatcacagctgtgaagtggggtgggaatgtttcccctcgttttctaggagagaaattttgggttcagtgagacgaagtgctgcagacaggcccatggtgatgctcaggcctctgcttgaagttggtgctcacttcctggcaccacttcctgcccccaccagtgcttctggcagagcccagggcagtggctttatggaactgtgtaaggtgataggaacccacaggnggaatggccgtgtggcctctggactgaggagggctggaccaggttgtgggcacgcctggaacacacgccacatcctatcccatagcgaggcctcttccttgtggctctcgaaggatttgaggacgcgggagggtgaantgtttccagagaaatatccaggacttttagaactaggctttcaaaagcatttacctgtcagataaattcaagtggcatcaatgcagattttaaatgtgtacagatatctccactcgcacgctgagttgtgcttcacacaagttttgcgcacggagtattccattaaatctactgaagcagtggggcaaggagaaaggagaggtgactgctgatgtttttaaagctctgacagtcacatatagattgtcccaggtacccctgctgcccccaagacactccaaaggcaaagatggatggtgacaaagtaaccttcatgcagaaacaagaacagtcacccccaacaacaagccctgctgaaggtgaagaatgccaccaggctgcctggcagttactgagtgcttattcctgctagcctattggagtcacgtcanatttgttacatggtaacttaattgtgccttccacgccttcacaaaatcagttgtacaagagaaggcacccaccacagtccatgtgacctttctcggtctgatttacatagtggggatgatgacactcgcgttgtagagtagttgcacgattaaacctggcacacagacataaagcactcaatgtctgacacatagtggactctcaagaagtttgtcatgcaggggacacttgaatgcccagtatgggccagacagcatcagctcatttcagtcccacagccctgtgagggaggaactctgccctgttttacagttagggaaattgaggcacaaaggctaagaagtcgatatccaagggcacagaatgattgggtgacggtgagcccaggcagtgtgacaacaaggttgctgccccacgccacctctgtctttcgtgggtatgtcggtgtgaggtgtaggcagccctgcactggcattcagcaggcgggactcccgggcaggctcttctgcgaacactcatgggccaccagccctttctggaacttgccttttttttttttttttacctgaaagctacgtgaatcgttggaaaattggtgtaaaaatggaactgagtcatctcaaaagttcctttcagttctaaaattctgtgaattgaagcctactttttcactttaaatgatttattgggtttacagttctttacgctttctgattgaactgatttgaagttcttatttcgtgtgttggggaacacacccccaacccgtcacagcgtggccgtgggtgggagatggacgttaggctggccagtcactagggggcagcatcagcacgggtctggctgtccctggccttagggagcagtttctgcccctcctgccccgtcagaaagtctcggactcctctctgcttgcatgtgtaaagttttcattttcaggggccttttagtcaaaaaaaataaagctgtatgacttagtgctgaaggatatgaattaggcntagctcttgggttggcagcataaaccaaggggcatcaacccaccaccgacaagctaagaatggtttttacatctttaaatggttgaaaaaggaaaaagaatgtttagtgacacgtgaaaaatacatgaaattcaaacttcaatgtctacaaataaagtgcattagcacacggtcgtcttgcttctctaaaaa

SEQ ID NO: 326680 - DNA, 427 bp, Homo sapiens
  misc_feature (359)..(359): n is a, c, g, or t
tccagagacaggcaggggcaggcaggggctgcaggcacctgcttcaccgcgggagggagccaggagaagtgggtcccagaggaaaatcttcctgtacacgggctgcattagtggtacctgagggcatctggaagaccgtggttctccttgcaacagtcacctaatggccttcagtgaaaagacagactccttgactctctctttccccaaacacattcctacagagtggaagtttccagagaaaacagccatcaaagaaggttgagagtgagaattaagagacactggagaagatcaagagaatgtgccctgaagacaacaacaaaaatcaataaaagatttcaagaatgaaatcccgnaatgcgggccggaaaacatattattgctttttaaactgactagcgagagttttgttaataatagaaat

SEQ ID NO: 326681 - DNA, 252 bp, Homo sapiens
gcggccgactactactactactgctcgaattcaagcttctaacgatgtacggggacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttaaaaaaaaa

SEQ ID NO: 326682 - DNA, 2610 bp, Homo sapiens
cggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgttgtgtgtgtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgagattctgctggttcacaaactggatggccacaacgccttctcctgcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttaaaaaaaaa

SEQ ID NO: 326683 - DNA, 2026 bp, Homo sapiens
gacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgagattctgctggttcacaaactggatggccacaacgccttctcctgcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttaaaaaaaaa

SEQ ID NO: 326684 - DNA, 956 bp, Homo sapiens
cggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaac

SEQ ID NO: 326685 - DNA, 2690 bp, Homo sapiens
cggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgttgtgtgtgtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgagattctgctggttcacaaactggatggccacaacgccttctcctgcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccccgtggggtgccacgccttcatgggacattgccacttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttaaaaaaaaa

SEQ ID NO: 326686 - DNA, 3090 bp, Homo sapiens
gcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccgacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctccccccacccaggagtatcctcttgccaaatcaaaagactttttccttgggctttagccttaaagatacttgaaggtctaggtgctttaacctcacataccctcacttaaacttttatcactgttgcatataccagttgtgatacaataaagaatgtatctgga

SEQ ID NO: 326687 - DNA, 4737 bp, Homo sapiens
gcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagcccccctaagcccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggttacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctccccccacccaggagtatcctcttgccaaatcaaaagactttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatccctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagtagaaaaaaaaaaa

SEQ ID NO: 326688 - DNA, 4532 bp, Homo sapiens
gcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagcccccctaagcccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctccccccacccaggagtatcctcttgccaaatcaaaagactttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatccctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagtagaaaaaaaaaaa

SEQ ID NO: 326689 - DNA, 2232 bp, Homo sapiens
gcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagggggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcacgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccccaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcacattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccatactctgtacctgccttgaattctttcctgcatgagatccaagaaccctctcttgggatctgaatcaggaccctcttttccagcaacgctat

SEQ ID NO: 326690 - DNA, 310 bp, Homo sapiens
cccatcagttgttcatgtataaaaggcaggagaataattgccttgggaactgtattgtttaataactgcattatctattagtttgtaaaagaaaaccctttgctttggactcagccctcactgaaccctaacgcagaacttggccttggaaacagtgtcagttagcccaactggtgccagcccacgggggcacgggactcctcggttaaggaaattctggatctcaaccttcctttcttccttagggaggatcaaccgccaaaggcacagctctgaagactggctctgatgccgatctcgtcgtgttcca

SEQ ID NO: 326691 - DNA, 2139 bp, Homo sapiens
gcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagggggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcacgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccccaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcacattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcacc

SEQ ID NO: 326692 - DNA, 4224 bp, Homo sapiens
gcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagcccccctaagcccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggttacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctccccccacccaggagtatcctcttgccaaatcaaaagactttttccttgggctttagccttaaagatacttgaaggtctaggtgctttaacctcacataccctcacttaaacttttatcactgttgcatataccagttgtgatacaataaagaatgtatctgga

SEQ ID NO: 326693 - DNA, 2145 bp, Homo sapiens
gcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagtagaaaaaaaaaaa

SEQ ID NO: 326694 - DNA, 320 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttcttgtctctttctttcttgttggagcttggggtcctctaagtca

SEQ ID NO: 326695 - DNA, 7606 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326696 - DNA, 7552 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattatttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326697 - DNA, 7416 bp, Homo sapiens
  misc_feature (26)..(26): n is a, c, g, or t
tgatctagaggatcccgacgtagcgnaatgaaggataaacatgctggactctagcagcttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326698 - DNA, 7552 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttctgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326699 - DNA, 7552 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326700 - DNA, 7552 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgatgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326701 - DNA, 7555 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326702 - DNA, 7552 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326703 - DNA, 7549 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaaagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326704 - DNA, 7552 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaagcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326705 - DNA, 7552 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccatgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326706 - DNA, 6644 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtacttattcagatgtaaggaatgatatattgcttaattttaaacaatcaagactttactggtgaggttaagttaaattattactgatacatttttccaggtaaccaggaaagagctagtatgaggaaatgaagtaataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326707 - DNA, 6565 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326708 - DNA, 3708 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326709 - DNA, 4579 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgacgttcctcatcccagtgacgttcctcatcccagtgacgttcctcatcccagtgacgttcctcatccgtgacgttcctcataccagtgacgttcctcatcccagtgacgttcaactccc

SEQ ID NO: 326710 - DNA, 3230 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatga

SEQ ID NO: 326711 - DNA, 2667 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttagtccatccctcatgaaaaatgactgaccactgctgggcagcaggagggatgatgaccaactaattcccaaaccccagtctcattggtaccagccttggggaaccacctacacttgagccacaattggttttgaagtgcatttacaagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326712 - DNA, 2609 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaagaattagacaagaaatacacagatgtgccagacttctgagaagcacctgccagcaacagcttccttctttgagcttagtccatccctcatgaaaaatgactgaccactgctgggcagcaggagggatgatgaccaactaattcccaaaccccagtctcattggtaccagccttggggaaccacctacacttgagccacaattggttttgaagtgcatttacaagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326713 - DNA, 2624 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttaggctatagtgtcttgcccgaattc

SEQ ID NO: 326714 - DNA, 2521 bp, Homo sapiens
ttcacacaaggaaacaagctaatgacccaattgattaccgaattagaggcctcggtaccccccaacaagataaagtctcaaaaacaaccaccacaacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaaaaaagaattt

SEQ ID NO: 326715 - DNA, 313 bp, Homo sapiens
gcttgtcattagaggactttagggagaccaagcaggctagaaagtagagacaggagatacctatgtctaatgcttcagtttatacttcctaggtttttttcattggggtttttgtaactcttttggtatcctaccggtgctttggtagcctactgaaccctgtctttcttcttaaggacattctgagcatgtgagacctgaggactgcaaacagctataagaggctccaaattaatcatatctttccctttgagaatctggccaagctccagctaatctacttggatgggttgccagctatctggagaaaaag

SEQ ID NO: 326716 - DNA, 2232 bp, Homo sapiens
atatctccattttctaataggaagcacttggacttaaaattgctaagatattttttgcagttgctatttctgtgcatcttgaatctatctgacacaatcaaatgacagtattgttaactctcacaccattaagaaaatttcttattttgtaggcattcactgtgagaggtaaaattgctgctttggcaggtatgattccagtttgccaaacggcttttcttccttccacaacctctttttcccctagcccagggtgaaacaagtgggtcatctccaaccttgatttttatttggattcagcattttgggtttggaaggttacaagaaggaaccataaatggccatattcctagatttttatttatctgacaaaatacacaacttaaaagccaggaaaactaaggttcattacagggagatgaactttttctaattggaggacaaattgtggaaggtggggtctgatctttgcttcaccacttgaagagactgtcatccttcacctgaggttccatttctagcttttatgtgacctctcttgaacaaagtcatttgggaacccccagaaatgacccctttacattgtaggaccataagcaaaacactggttgtgtatagtcactgatccccaaggacttgcagttttttatttctgctggtgtgtcttgggatcagcttataactcctactcttacttagtcagtgaccagtccagtctggtctggaccaggcctgacaaacttctgctcacttgcatcattttcattctgagccagtaggactttgggtagactttaaagcccaagaattggtactcgctttggctagtgacatttgatttttgtctccatcttgatttctgacatcattggccaagtcacattaactttttttgatcactgagaaaaacagtcgaacaaggcattacagagggtggttaaggtagagggtggggggcaggaatgcttatgtaggatagaaagaatgtgggggtagctgtttggttatggtgatccagtcctttggaaccttacaaggctcctgtgggcatgtcaatgttaccattacagcctctacgacccacccacctttgaaaagtcagtacaagtagaccacagtttaaagtagttagtataattctactaaggtttaatcattatacttgttcacttcctggtgcatatttcctaaatatgcttggggtgtggggtggggggttgagttttcactgttccattgcgtgtcatcttatatttttctccatcctgtgactttggcatcttactcgactttctattttcttttcccttggcttattgcagtagtctgctggtgcaggtagagagctcagtgcacctattcccctgttactgctaattatcttgaatattgtcagaggttattttgatgttctaagaatataaagtcattttttacaaaatcatcttttccaagttaaaagcaaaataaaaaaatcccctgtgctagggtgcccatttcagcttttgacattgcccctgtacttttatagatgctctttttgtccgtgttggtagtaactaatgactagtgaattttcatgtaaatgaagcaaaataaatatttcagattttattaatctctcataacccagccaaatctgatgacttcattttaattgcttcccagaaagcacttcccctcctaccttctattctattctattctattctattctattctattctattctgttctattctgttcattctattctgttctattctgttctattctgtttttagaataacacactaggtaaagaaactttaactgcaaggagtcagtgacttttagtgctccctgataaatgatgttattgacaaaagtaaaaaattatttcattgtttttttcctgtattactatctcctctcctgtgcttttgacagtgtgtttagtggatggataatatgtatttctctttcccactcccagattccaaattccctgcctttttggcccacctcaccacaaaagctccatagtttattaatgtaagtttgaatggatgcttctttggggaaacttcaggagttaatggaagagtttcagaaaggaatgagaatgcctcaggagttgttctgtgatggaaattggtctgttgttctgttaatgctgatggaaagaaacttacaacgcttaataaaaatctattcttttagtaaaaaaaattgtgaaataattttgggtgt

SEQ ID NO: 326717 - DNA, 1167 bp, Homo sapiens
  misc_feature (1066)..(1066): n is a, c, g, or t
  misc_feature (1143)..(1143): n is a, c, g, or t
  misc_feature (1146)..(1146): n is a, c, g, or t
atatctccattttctaataggaagcacttggacttaaaattgctaagatattttttgcagttgctatttctgtgcatcttgaatctatctgacacaatcaaatgacagtattgttaactctcacaccattaagaaaatttcttattttgtaggcattcactgtgagaggtaaaattgctgctttggcaggtatgattccagtttgccaaacggcttttcttccttccacaacctctttttcccctagcccagggtgaaacaagtgggtcatctccaaccttgatttttatttggattcagcattttgggtttggaaggttacaagaaggaaccataaatggccatattcctagatttttatttatctgacaaaatacacaacttaaaagccaggaaaactaaggttcattacagggagatgaactttttctaattggaggacaaattgtggaaggtggggtctgatctttgcttcaccacttgaagagactgtcatccttcacctgaggttccatttctagcttttatgtgacctctcttgaacaaagtcatttgggaacccccagaaatgacccctttacattgtaggaccataagcaaaacactggttgtgtatagtcactgatccccaaggacttgcagttttttatttctgctggtgtgtcttgggatcagcttataactcctactcttacttagtcagtgaccagtccagtctggtctggaccaggcctgacaaacttctgctcacttgcatcattttcattctgagccagtaggactttgggtagactttaaagcccaagaattggtactcgctttggctagtgacatttgatttttgtctccatcttgatttctgacatcattggccaagtcacattaactttttttgatcactgagaaaaacagtcgaacaaggcattacagagggtggttaaggtagagggtggggggcaggaatgcttatgtaggatagaaagaatgtgggggtagctgtttggttgggatatatttaaaggaattggtagttaaaaggaaggtggtgggtgtgtttattatattngttatgggggttaaaatggattatattgagaagtagagtttgaggtgattagaatgttttaaggtggaatatttttnttnagggtgaagtgtgttgaattt

SEQ ID NO: 326718 - DNA, 3249 bp, Homo sapiens
tgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagcaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggttctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacag

SEQ ID NO: 326719 - DNA, 2282 bp, Homo sapiens
  misc_feature (2225)..(2225): n is a, c, g, or t
  misc_feature (2242)..(2242): n is a, c, g, or t
  misc_feature (2251)..(2251): n is a, c, g, or t
  misc_feature (2260)..(2260): n is a, c, g, or t
  misc_feature (2274)..(2274): n is a, c, g, or t
tgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtgggaaataactgaaaaagagacacgagaagacgaatcnttaccggtctgaataanatacactangattctacngaggtgggaaccgnacgaactc

SEQ ID NO: 326720 - DNA, 3078 bp, Homo sapiens
tgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggttctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacag

SEQ ID NO: 326721 - DNA, 942 bp, Homo sapiens
  misc_feature (885)..(885): n is a, c, g, or t
  misc_feature (902)..(902): n is a, c, g, or t
  misc_feature (911)..(911): n is a, c, g, or t
  misc_feature (920)..(920): n is a, c, g, or t
  misc_feature (934)..(934): n is a, c, g, or t
ctgaccatagaggatcccctcgaatcgacggtttctccacgatacacaggcttcccatctaaagtcatgcttaactaaaagggaaaaaaaatgaaccaagcaaaagtatatagagtagccgtgacatttgcattattttctagactttacatttgcctgcaacaggcataacatgaaactccagagggaatttggattgataggaatgttcacataaacaccagcagtggctaactgttacacaacattcaaagtattcgagagaactgcagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtgggaaataactgaaaaagagacacgagaagacgaatcnttaccggtctgaataanatacactangattctacngaggtgggaaccgnacgaactc

SEQ ID NO: 326722 - DNA, 738 bp, Homo sapiens
  misc_feature (681)..(681): n is a, c, g, or t
  misc_feature (698)..(698): n is a, c, g, or t
  misc_feature (707)..(707): n is a, c, g, or t
  misc_feature (716)..(716): n is a, c, g, or t
  misc_feature (730)..(730): n is a, c, g, or t
ctgaccatagaggatcccctcgaatcgacggtttctcatgtataaacttttcatggagggatttctagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtgggaaataactgaaaaagagacacgagaagacgaatcnttaccggtctgaataanatacactangattctacngaggtgggaaccgnacgaactc

SEQ ID NO: 326723 - DNA, 322 bp, Homo sapiens
ctggctatccttcattcatttattcaaaaacatttattgagtccgggagcggtggctcatgcctgcaatctcagcaccttgggataactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcactcttgtgatgcacgtgactagctggcatcctggtatcct

SEQ ID NO: 326724 - DNA, 3076 bp, Homo sapiens
tgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggttctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacag

SEQ ID NO: 326725 - DNA, 2987 bp, Homo sapiens
tgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggttctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacag

SEQ ID NO: 326726 - DNA, 802 bp, Homo sapiens
  misc_feature (745)..(745): n is a, c, g, or t
  misc_feature (762)..(762): n is a, c, g, or t
  misc_feature (771)..(771): n is a, c, g, or t
  misc_feature (780)..(780): n is a, c, g, or t
  misc_feature (794)..(794): n is a, c, g, or t
ggtgctctgacgatcccatgcgcgacgcttccactcacgccagcagacgaacactccctccatgaaagttaaaacaatgataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtgggaaataactgaaaaagagacacgagaagacgaatcnttaccggtctgaataanatacactangattctacngaggtgggaaccgnacgaactc

SEQ ID NO: 326727 - DNA, 672 bp, Homo sapiens
gcgggtggggggtgcctggggccgggctgatggggggaaggcgaacggaggccagtgtggggctgggacagactggaggggtctctagaacgggtgatgcggttggaacgggtgatgggttgacagacaaggtagtgcaagggcagaggcttctggctggaagtcctggacccccagcataaaggaggggaggaaaggaagggggctcatataaagcaggagaccctgagccccgacacaggtggcgtgggggaggacacgcagaatgacgaggataaaacccgctcttaggaccgtggcttctgtcctgggtctcagggcacacgcgcgcacacatatacaacacaagatgcttctggcatgaggggcagggtcccagagaccccaccctcattcaagctaaaaactgggaggggctgagcaggggctgggaccaagacccatgttttaccagtggggcgagttttgttggtttttctctccaaaagggaaatttaaaaatctacaacaaatcacaccaaattcattaaaagtgataaaaacccagcctccccctcctcacttgagctttcagacgggccagaaaagctcaacgatgaagaaacaggaacatgcccaggtcaggtctccccacccaaacacaagtccggagtgggagcttggagctggatg

SEQ ID NO: 326728 - DNA, 186 bp, Homo sapiens
  misc_feature (43)..(43): n is a, c, g, or t
gaattcaagcccgggggtaatgctggctcgcagttttctcacngtgttgactgaagggttttttgccgtggctcaacagctttcgagccagtgtgcaccctccgagttctacccatgagccatggcattgagatgctgaggtcttccttcctccagccacttcgccaatccaaggctccttgctgc

SEQ ID NO: 326729 - DNA, 190 bp, Homo sapiens
tccatctcaaaaaaaaaaaaaacctaagatgataacattgacagctagtgggtggagatgctgctaaacatccttataatgcacaggacagatcctttctcctcctcttcccccgatctcacaaacaaagaattacctggacctaaatgtcaattgtgctaaggcgagaagctctttttcagagagtgct

SEQ ID NO: 326730 - DNA, 195 bp, Homo sapiens
ataagagttttgttgattagaataggaagctatacactgtaaaacgtttattcagttatatgtatatattatctcaaattacataagatcatatggttgtagataaaaattttattattttgtcattacatactttacttgcatttctcccttgaacctgcccttatcttcctttttttcttttcttcctactgt

SEQ ID NO: 326731 - DNA, 116 bp, Homo sapiens
agatggaagtaaagaaggttgttctctaaacaagtcacataagaagctgtatcctcagtctctcacgatcctatttactattcctaggcactatctcccacattctcacatggcca

SEQ ID NO: 326732 - DNA, 363 bp, Homo sapiens
ccataaaagaggcagttaagcaggggcctgggacccccacatggccagtctaacttagcacctggcctctcaactgcactcttaattttccaagtgttttcatatctactatttcacctcttcttcgcaaaagcccatgaggtagcctaggatctcatcagcctctctactagacagaaataaaatggggaagaggacaaagaatgactgaggcagaaccggggttagaacttgagtctcttgcctccccagcgtagatgtgagtaaggtccctgggaacaggggttcctcgggaggcgcctcacagcagctcacacctgcctggcgctttttaccagaggaaaggacgcagctgcctcccag

SEQ ID NO: 326733 - DNA, 1013 bp, Homo sapiens
catgtgcactggcaagcaagagcctgcggttaggtagaacagtgactgctgcaattatctgggtgtgagaggataagtagtctggacttggatggtggcagtaggaatagagaggaaggactactaaggtgaacacctttagaacctggtgactgactgtgaaggaaacggataaggtaaagacaatcttctctcgcttcccccttgaaatcacgccgagtttaattctgtagccccaagtgaagaacaattattcccagcagtactaggacctgcctacaaataggagagcttggaatagaattatctgctctgaacacacaacagaatcctttcctctcttgtcaccctgctctggaaaataaaacatttctcatcttttgaggtttcctgtattttccccacctttttcagcccactgaactttctgaaaacatttccctagacactttgtttataatcctcttggatgaaaaaggcaggactgaatttcaagatttttgtgataatcagtccaaactatggacaacttttgtttgtttccctgcaagcaggattgccatttcctaaatccggtgtggtctccaggttggagcaaggagagccatggatcccagatctgctgggctctaaggagaaagaacttcccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggtcttctccggaccctggaacagtgtcggaccaagttcaaaggtctccagaagagctatcggaaagtcaagagcggccacccacctgagacctgccccttctttgaagagatg

SEQ ID NO: 326734 - DNA, 242 bp, Homo sapiens
tggtcagggagaagggggttgggaatggctggcaaattggagcaccaacattacctttatggataatttcttttaaaaaatagtatagctgaaatgcatctgttaaaaatgtcatgattgaaagcagaactgagtttcaaattacaaccttaaaattgttgttagatatttcttcacatatcagctatactattttttcttggccccactccccaacattctgagaatggactaaaatagtg

SEQ ID NO: 326735 - DNA, 2248 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgtttaatttctaggctttttttttaaatagacggagtcttgctctgtcgcccgggctagagtgcaatggtgcaacctccgctcactgcaacctccgcctcccaagttcaagcgattctcctgcctcagcctcccaagtagctgagattacaggcgcccgccaccatgcctggctaatttttgtgttttttagtagagacagggtgtcaccattttggccaggctggtcttgaactcctgacctcaggtgatcctcccacctcggcttcccaatgtgcttggattacaggcataagccaccgtgcctggccaatatctaggctttttactagcagttgaaagctagtttgtcaaatagagtttttcagagctttagttttgcatttaccccagccttttgatacacaaataggtgaagtttttctgaagtggagtttgcagttccccactttttgtatactcacgctctgcccctgctcctgggcttgcctcagacaaggctgaggcattagtagggcttaaacttttttaacaagcctcaacaa

SEQ ID NO: 326736 - DNA, 1655 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagactatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgttta

SEQ ID NO: 326737 - DNA, 1796 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggtaattcagttttgcttttagagggattgaaacatgttgagacttaaaacattggttagtgcactttttcttcttctctttaatcaggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgttta

SEQ ID NO: 326738 - DNA, 1641 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatgatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgttta

SEQ ID NO: 326739 - DNA, 2010 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaaggccgggcgcagtggctcacacctgtaatcccagcactttgggaggccgaggcgggcggatcatgaggtcaggagatcaagaccatcctggctaacacgaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggtaattcagttttgcttttagagggattgaaacatgttgagacttaaaacattggttagtgcactttttcttcttctctttaatcaggcgatgttttctctggcctgtattcttccctttaaatacccggcagttctgcctgaaattactgtcaggtacgttacagaagctctggccaactttggaggtcaaaattaatctgagaataaaagcaattctcgaatttgttttctgttccaagacaatatttttcttgtatcttttctattagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgttta

SEQ ID NO: 326740 - DNA, 383 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaaggtgagtctcgcctcagctagcgccagtggtgaccgccacgggggtttcccacgctgcagcgcccagtgcaaccctttgggaacgtgcccggcatggcggccccggttcccctcactgcatgcgcccatcggtcggctcggtcctcggcgttgcttcccggcttctgcagccctgctccagccggggacctcgccccgggggcaatcagggtgcgagggcggccgc

SEQ ID NO: 326741 - DNA, 882 bp, Homo sapiens
cacatgttgatgtattcatttcttccaagattgcatatgtaaattgtctctcttatctttacctccttagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggtaattcagttttgcttttagagggattgaaacatgttgagacttaaaacattggttagtgcactttttcttcttctctttaatcaggcgatgttttctctggcctgtattcttccctttaaatacccggcagttctgcctgaaattactgtcaggtacgttacagaagctctggccaactttggaggtcaaaattaatctgagaataaaagcaattctcgaatttgttttctgttccaagacaatatttttcttgtatcttttctattagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtg

SEQ ID NO: 326742 - DNA, 1709 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgttta

SEQ ID NO: 326743 - DNA, 1807 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaaggccgggcgcagtggctcacacctgtaatcccagcactttgggaggccgaggcgggcggatcatgaggtcaggagatcaagaccatcctggctaacacgaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgcaaaagaaagaatattctagagtgggcaaaggagctttccctgtctgggtttagcatgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgttta

SEQ ID NO: 326744 - DNA, 1654 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatggcgatgttttctctggcctgtattcttccctttaaatacccggcagttctgcctgaaattactgtcagatcagtattattgagtagatcccagcagactcagctgaacacagatctgactgcattcctgcaaaaacattgtcatggagatgtttgtatactgaatgccacagagtgggttagagaacacgcctctggctatgtcagcagagatacttcatcttcacccaccacaggaagcacagtccagtcagttgacctcatcttcacgagactctggatctacagccatcatatctataacaaatgctgcctggaaaacctggtgttgtttgtgtggaaggcccacaaagtgcctgtgaagaattctggtcaagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgttta

SEQ ID NO: 326745 - DNA, 1278 bp, Homo sapiens
gcatgcttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagaagacaatggaggggcgatcttcaaaagtctactttactatcaatatgaacctggatgtatctgacgaaaaaatgactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacggaagggccaagagaaccacgaagatgccagttgccacattgttgagctgctgacccaacaccagccattgcctgtctctaaacatcttatgaaataaaaccagttttgttta

SEQ ID NO: 326746 - DNA, 486 bp, Homo sapiens
aagctacaacatgcatgaaccttggaaacctgtgttaaatgaaagaagccagtcacataagaccagatattgtatagtcccattgatctgaaatttccagaacaggcaaatcaatagagagaaaaagaagactggtgagtgtctagagctgggggagttggaaggcaatgagggttgactgctaatggatatatggtttcttctgaggatgattgaaaatgctctaaaaattattttgatggttgcacagccctgtgaatatactaaaaataattgaattgtagactttaaattgtaaatacgaaaagtgaattctatcacaagaaaactgttattaaaaaacaaagactactacgtagtgatgtgtcgttcccactagacactttaagaggcattttatgccagtttgccccactgttgttgacgctaagttttgatcactgggataatttggtttccactggatcttgtcattgcattaggttg

SEQ ID NO: 326747 - DNA, 965 bp, Homo sapiens
ttgagaggggaagagctgagtgcgggctggagcagcgagaatgcttcacggaggatgttggggagagaggatttgatttgccgagtggtttggagatctttaggggcgggtaggggaagagggtggctggacttaaggtaggagccgaaagtgggcatgggagcccatccccgtgggtgtgaggccggggtaggaccaggcttcccggctaggcacgcctggctggctgcctctgcctctactaacttcctttgtctctttatcctcctgcttaggccgtgtcttcctctctctctgccattttctctatcagaaaacattaaagctgagtagaaacttcaagatgatcattctggcccagcccttttatctctttatctccaatggtgtgcgttttaagtttctctgacttggtttttctgtccctgtctcccacagttgttcccgctctgcacctgtgtttcagttactctctctctctgtcttagatctttttgtttctgcctagtctctgtgccctgtctttgtgtgtttctttctctgcctgaaaccctccctcttttcccttcaggcatatgtctctaaaccaatgttatgtatcaaagactgttgaaagagacagggctactctaggaatggatgggtggggatattttccccatggatcaagatccagtttagggttgggaaataaaggatagggataaaagaggcaccccattcagtcagcagatacttattcagcacctactatgtgtttgatactgtatacaaaagacatgaatgggctgggtcctgaacagagaataaagggtttgactccattctggaaattcttttgtttgcaaacaggtgttgttaatttgttcaaaggcaggcaaacaatctctctggcaacacaattttcttctgtatttaattaaaaaatattaaagctttttttctatgatgaatgataaaatatg

SEQ ID NO: 326748 - DNA, 773 bp, Homo sapiens
gggaagctctgagtcactgaatagcaaagaaaaatatgaaagcaagaggaattgctttcacatctagaaaatgttgcaagataatctgaaatcttctggtgctggtgaatgcatgaagaggttcacagtatcttttaaagtacttctgaaaagataaggagtttaaaaggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcaca

SEQ ID NO: 326749 - DNA, 660 bp, Homo sapiens
gtattggttaccgggagtgtggctggtttctgttgcctgttttgatactcttctcctggggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcaca

SEQ ID NO: 326750 - DNA, 448 bp, Homo sapiens
gtattggttaccgggagtgtggctggtttctgttgcctgttttgatactcttctcctggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcaca

SEQ ID NO: 326751 - DNA, 427 bp, Homo sapiens
  misc_feature (57)..(57): n is a, c, g, or t
cgcaccacgcgaccccgtatagataacaacaacacttcaggtaccacccagagctgntaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcaca

SEQ ID NO: 326752 - DNA, 679 bp, Homo sapiens
cgaaatgactggcatttgcagtgctattcatttgtaaaattccttctaggatcagatgtgctagcataacacatgaattgataagtagttatgtgtacatgctgcaagagttgttctgttttctagtaaaagactcttttctcatccttagatctgttcgcagttgagtaccaggctggagaaacagcaagcagccagcaaggaggagctggaagtggtaaaggtaaggagtgaaatcgtgctgtgataaaatttatttcaaagtcacacaggcttgtaagtacctgaaagaaccccaaacaccaccattttgtattaaaggatttattaataggaattatggagactaggatacctctcttctgaccaggtgtgattgtcttccctaccaggtgaaaggttatgatgctcccataaatcatatggactgtcagaggcagctaacatgaaaggaagtaggatttgacattgtcacaagaagccccagagcttgagatgagagtggtatgaacctgagaaccctcagcagcccacatctgactgagcctgcattgatgtggcttcagtatgggactcagtaggatcatcccatcactctctttataagtaaacaccatgggcaatatagaacttagctggaaaaacatgtgttgggtaactgattcttgcactaagtttt

SEQ ID NO: 326753 - DNA, 676 bp, Homo sapiens
gtattggttaccgggagtgtggctggtttctgttgcctgttttgatactcttctcctggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacaaaaaaaaaaaaaaaaaaaaaaaaattgggggcatttaattgttgggggtggggaaaaaaggttttgtgaaggtggccgtggtttctaatggcggtgtttcctggacccagttttttggtccaagggtggaaaacctggcgggtccccaaataggggagccggaattaaattcagataggcaagggttaacctgttaggtattttcgtagaaaaagaaaggaagaaaaa

SEQ ID NO: 326754 - DNA, 7109 bp, Homo sapiens
  misc_feature (151)..(151): n is a, c, g, or t
  misc_feature (363)..(363): n is a, c, g, or t
aaaatatttttatgtgcttcttttaaaaaatacacaaatgggcacaggtggtatttatttgttcttagattagtggaataagggttagcattctgaaattcaaacaaacaaaaagaaaacctttatatacaggatcaaacatgttgatttntactttccttcccccacttccgtggcttttagcatctgaaaatggttagtaagaaaagaataattagttggtgagcctttccaaacaccaaaagacaggacccatatattatatttggttaacgctcatggacacttttagtattttttaaaaaatcaaatgaagtgatgttttgttctaaagcgtcattctcaaaatttttgtaaaaggtnacgtttctgatcattcccattcccagaaatagaagtgcagcgtagctcatgtaagttatggctcttcacctgcaaaaacaaattctgaataaattctgcatacttaacctcagcaaacaaagacctgaaagattcaaaagatgagaatcttgctcgtgccgaattcggcacgagggcacatttggctatttttcaaagagagcatgtagttcaagaaatggcttattttgttttttattcttctttttgtggtctatttaggaaaacaaaatgaaggtggcctttgtctttcagttatggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326755 - DNA, 6797 bp, Homo sapiens
tgtctaaagagggaagtgaagccagtaggagactgagagattagaagaacagggcagtagaggatgaatttgcagtgaggttaaaggaacaatttattgggagaagggaatgtaggagggtagaagactttaaaattgaaaagaaataaaaggaggcagggatgtaaaacgagccataagtacaatgacaaatgggcattaaggaggaaaaagactatgtagaagaatctggtaaatatggatattaacagcaataagctcctttttaacgatttaattctaccaagtaaatatttgggattactcgctttttgccttttatttaccaaaaaattcatatattttcaaaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326756 - DNA, 8758 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326757 - DNA, 9091 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacaagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326758 - DNA, 8704 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagcattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326759 - DNA, 7306 bp, Homo sapiens
tgtctaaagagggaagtgaagccagtaggagactgagagattagaagaacagggcagtagaggatgaatttgcagtgaggttaaaggaacaatttattgggagaagggaatgtaggagggtagaagactttaaaattgaaaagaaataaaaggaggcagggatgtaaaacgagccataagtacaatgacaaatgggcattaaggaggaaaaagactatgtagaagaatctggtaaatatggatattaacagcaataagctcctttttaacgatttaattctaccaagtaaatatttgggattactcgctttttgccttttatttaccaaaaaattcatatattttcaaaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacaagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326760 - DNA, 6906 bp, Homo sapiens
ctgtaggcatttgaaaacttgaatatgatagctgtcaactcttttaaaagaggtatccaaaagaaaatatgtgagagttgagtgtgttgttgctaataaatttgcactgagtcttttaggaaaacattttctcctgacccttaaaagtctttaaaagcatgtgccaagaattcatcatagcagcagacaacacccaaaatattgagctagggtttataaagccgcctccctcctcgtcattttttcctttaaagcttagtttctttacttttaattaacagttcacatttctctggtttctcatcttgaaataaatgacgttcacaatcccttgaactgcttcacccagacttcagcccccaggtacacatgagatccaggatccatttttcttttgcattgccctgcccagcaatttcattcttttgtctgaagatgaactattttgcaagatttctgaccttgtcatataaggaagttccttccacccagctttaacaacacagtatcaacacctcacaccgtagttccttaatagtcccacatacagcattttagtcattcatgcaaactgtaaacagcaatgtggagagggaggagtttgaagatatgagtcttcctgagttgagacttgcccactggctacctcaagtatctttgttccattgaatgtttgcggtcacagagagaacttagagttatatgacactcaaaggaaaagcaaaagagcattaagaagtgtctgtttttgttattgccatttcataaatattttagtaggtgttcaatttcattggatattctttttttttaattgtctttgtacctatgattgaaaacagtagttggtctatgacttttgaggagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326761 - DNA, 3043 bp, Homo sapiens
  misc_feature (2)..(2): n is a, c, g, or t
  misc_feature (71)..(71): n is a, c, g, or t
anattcggaacgagggagttttgctcatgcagtggcacaatctcagctcactgcaatctctgcctcctggnggaagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326762 - DNA, 5434 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtga

SEQ ID NO: 326763 - DNA, 1507 bp, Homo sapiens
  misc_feature (26)..(26): n is a, c, g, or t
  misc_feature (32)..(32): n is a, c, g, or t
ttagagcataaactattacagcatanactatnaagcataaactattacgcataaactgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326764 - DNA, 3118 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacaaaaaaaaaaaatccacacacacccccaccccccccctcccccctacccctgcttccccgcccgccc

SEQ ID NO: 326765 - DNA, 3880 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacaagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaaggtaaggagtgaaatcgtgctgtgataaaatttatttcaaagtcacacaggcttgtaagtacctgaaagaaccccaaacaccaccattttgtattaaaggatttattaataggaattatggagactaggatacctctcttctgaccaggtgtgattgtcttccctaccaggtgaaaggttatgatgctcccataaatcatatggactgtcagaggcagctaacatgaaaggaagtaggatttgacattgtcacaagaagccccagagcttgagatgagagtggtatgaacctgagaaccctcagcagcccacatctgactgagcctgcattgatgtggcttcagtatgggactcagtaggatcatcccatcactctctttataagtaaacaccatgggcaatatagaacttagctggaaaaacatgtgttgggtaactgattcttgcactaagtttt

SEQ ID NO: 326766 - DNA, 2657 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggtcgacgcggccgcgaatttagtagtagtagtcgacc

SEQ ID NO: 326767 - DNA, 2197 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagctgctacagtctcgctggagtagcggatcacgacctaatcctcaggatcagctatgatctagtgtttacgcatcgcagccgcc

SEQ ID NO: 326768 - DNA, 365 bp, Homo sapiens
agaacctcagacatgctgtagatcaaacacaacacgccattcttcattgcagctcttttgaatgcattatttaaatactatctttcaatgtttccttcagatttctaatacttaaatatactgttatatttttctcagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagagggtaagaagttggacttactcagtttattctgtctgtatagctgctttacttacaatcttcagaggaggtgtgtgtgttgtgggta

SEQ ID NO: 326769 - DNA, 303 bp, Homo sapiens
cttaaagcagcagttgtggcaagttcaattccctctgttcttccttgattgatttagatgctctctgatcatgctaactgtccaggtatgttttcatttcaggagactcccaaatagccaaccataatatttcttttctttcagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatat

SEQ ID NO: 326770 - DNA, 254 bp, Homo sapiens
acagcaatcctgccttcctgtgccacttgcgccttctcctttttacacctttgaaagttcactttgttgcttgtttttcctcaccagttctgttcgtttctgtatgtccagacactaatgcccacctctggctattgttcttctgcagagggagaaccgaagattacaggaggccagcatgaggttggaacaagagaatgatgaccttgcccatgaactagtaacaagcaaaattgctctacggaatgacttgg

SEQ ID NO: 326771 - DNA, 6950 bp, Homo sapiens
  misc_feature (6931)..(6931): n is a, c, g, or t
  misc_feature (6933)..(6933): n is a, c, g, or t
  misc_feature (6937)..(6937): n is a, c, g, or t
  misc_feature (6939)..(6939): n is a, c, g, or t
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctggtacnanctcnantctatctgtat

SEQ ID NO: 326772 - DNA, 3052 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcaca

SEQ ID NO: 326773 - DNA, 3038 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagagtggtatctctgcccttcagttcactgggatggtgactttctaaagtgtctgcccgaatgttggcacccgtggcatcggaacattgtccatgggttttctggaacctagattcaaattttatcttgaagatacatgaatttctaatgtcagttaagaaaactagcaacatttgtgctacagaaaagataaataaatttattagccttcccgtcacttgtcaactgtgacttacaatcagtgtttgaaaggtcataatgttcattaatattaataagaacatcatagatattacctttcctccccttaaacctgtactctatagctgtttaaggaagttggaaaacttttcaaaacatagattgtaatcatagcatcatgatgttcggggaagtaaatggtaacatcctttaccattaaaattgcttttcagaataatctattggaaacaatattgtagtgtgcctcaggatatttattctttccactaactcatctttgtcaagaattattttacaaaggaaatttttgaataaacttttacttcc

SEQ ID NO: 326774 - DNA, 3053 bp, Homo sapiens
  misc_feature (3000)..(3000): n is a, c, g, or t
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggtctgttggagtttgctggaggtccactccagaccctgtttgcctgggtatcaccagtggaagctgcagaacagcaaatattgcagaatggcaaatgttgctgcctgatccttcctctggaagcttcatctcagaagggcacctggctgtatgaggtgtcggttggcccctcctgggaggtgtctcccaattagactactcaggtgtcagggacccacttgaggaggcagtctgtccattctcaggtcccaaactacatgctgggagaaccactactctcttcaaagctgtcagacagggacatttaagtctgcagaagtttctgctgccgtttgttcaactatgccctgcccccagtactggagtccaggaaggcaggcaggcctccttgagctttggtgggctccacccagttcagtcttcccggctgctttgtttacctactcaagcttcagcaatggcggatgcccctccctcagccttgctgacacttgcggcttgatctcagactgctgtgttagcagtgagtgaggctccgtgggtgtgggactctccgagccaggtgcgggatataatctcctggtgttccgtttgctaagaccattggaaaagcgcagtattagggtgggagggtcccgattttccaggtactatctgtcatggcttcccttggctaggaaagggaattccccaaccccttgcacttcccaggtgagcaatgccccacgctgctccttgggctgcacccactgtgtgacaagccccagtgagatgaacccggtacctctgttggaaatgcagaaatcacctgtcttctgcgtcgctcacgctgggagctgtagactggagctgttcctttttggccatcttggaacctcggttcaaacctgagttgtaatactcactcttcctgttgctgcctatgtaattttgtagaagttacctaattgcttccaagcttctgttggattttttgagaactgaatgacatagtacattttgantgcttaatgtattgctttgtgcatggtattatttaataaatattagctttggt

SEQ ID NO: 326775 - DNA, 462 bp, Homo sapiens
ctacaataccttctatttctagggtatttctagagatacttcaggaaaaaggagcacccgtcttggatagttgggttcgggctaatgattttgattgcagcacaagaaaaataattaaccttcagaaatgggcctgcatctatgacaataagcagcatctaaaaaagtcataaattgtttcagaaggtgatttagcctatggaatagtttgatgttggttatctcttttggatactttagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggttggtgatttgataaaagaacaa

SEQ ID NO: 326776 - DNA, 6345 bp, Homo sapiens
agcggtaacataaatttaaatatttttaacacgaattccgaattcgggtttgactaactttttgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326777 - DNA, 8647 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326778 - DNA, 7086 bp, Homo sapiens
  misc_feature (151)..(151): n is a, c, g, or t
  misc_feature (363)..(363): n is a, c, g, or t
aaaatatttttatgtgcttcttttaaaaaatacacaaatgggcacaggtggtatttatttgttcttagattagtggaataagggttagcattctgaaattcaaacaaacaaaaagaaaacctttatatacaggatcaaacatgttgatttntactttccttcccccacttccgtggcttttagcatctgaaaatggttagtaagaaaagaataattagttggtgagcctttccaaacaccaaaagacaggacccatatattatatttggttaacgctcatggacacttttagtattttttaaaaaatcaaatgaagtgatgttttgttctaaagcgtcattctcaaaatttttgtaaaaggtnacgtttctgatcattcccattcccagaaatagaagtgcagcgtagctcatgtaagttatggctcttcacctgcaaaaacaaattctgaataaattctgcatacttaacctcagcaaacaaagacctgaaagattcaaaagatgagaatcttgctcgtgccgaattcggcacgagggcacatttggctatttttcaaagagagcatgtagttcaagaaatggcttattttgttttttattcttctttttgtggtctatttaggaaaacaaaatgaaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326779 - DNA, 8794 bp, Homo sapiens
agaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326780 - DNA, 6976 bp, Homo sapiens
gcagcagcagcagtagcagcagcagcagcaacaacagcgctgcttgtcacgaatcgaggattgcaatgagctcatcgttttctccttgcagcttcacaactgccctggcttcctggctactgctgctgctgtcttctcacacatagacacgcacacacaccctttctcgcacacacacacacacacacacacactctcacacattctcacatgctagacccttctaagcagcttgtccgtttttacacatgtatctgaactctcctgcatcactcttggccattttctcgcattcgattgcttttgccgttttttatttagatcagtacttgatttcattttcattttccagtctactttggggttctcgcagtggataatttagccaaaatgtttttcttgtggagacattagctgacaattcccaccacagactggcttgtacgtcctcccagggagacctaaacctggctcccctcccaccgcagttcttaatattgtggataagagatccatctttctcattctggatacctacttagtgctcatggaagaaggggtgccctgcccagccccagctgctaagctcacacctcctgtcaaaaagtcccaggacatgcacgacgagaggagcaagctggtgaatgagtatgcgtgtcgagtgctggaacttctggggatggggcatcgtctgtttgtgcctcggcttctggcgacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcatttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccaaaaaaaaat

SEQ ID NO: 326781 - DNA, 2336 bp, Homo sapiens
  misc_feature (1329)..(1329): n is a, c, g, or t
  misc_feature (1739)..(1739): n is a, c, g, or t
gtagatgtgagagtagtatctccaaataacttaacaactgtgtctctaaactgtattgtctacattttaactgtaaaagtgttcatgatacatgctttgtacatatgaacttttttccacagtagaaataatttggcttataattttgccttccccccaccttgaaatatacaatacaaagtaattcatgaaacaactttctcgttgaaattttgtaacttgtgtttaaacgataccatttcctatccacaagtgatcactggaaagttgtttgagccgtcgcgccatggcagagtagaaaggatggcccaagatattctctcatgtccagctggttgcctttttgaggtctcttgttgcatcaagtgctacaaggaggattacccagccactggcgaggaccaatacctaatccccaggtcgagtgcagagccttgcgtcatgtgccatgtgccgtagtggcctcagagaaggctgtgcgggcgggctcctggggatgcagtcaccttgcagacatgtggacaacaggcaagatgaggatactggagacagtcaaaacacacaaggaaggctcagcaatcaagagaagttataaccctgcatatgcaccacacaaaggcaacttgatgattggagatgtcagaagtagacatggggaatgaagtagaaaatattagcaggtaaaggagacagaagaaagcaaatagaatgtagagcccacagctggactagcatcagccatgttttggagctacaaagtcactccagcagaagttccacatgaggaagtgatatttcctgatccttccaagacatttccctgtagacttaagtggatcataactcccagtattcctcattttactgagtgctgattttcctatttattataacactattatgacagggatatgcatacatgatatactgaatatgctgtgttgatgggcagtacactcaataattaaagagtgttaacgaaattaattttttaaatattaaaaagtattttctgtctttttaaaataccatctatacctttaaacagtttataaagcacatgtgaagcagccaccatgttgcgttagacgtgtaatttacagaggtaacaagcagagaagagtccttagcattgtgaaatggctgggtttcacagacagctctgcccgctatgggaacactaagccaagcataaattctcatggcgtgggagttagtggaagaatccgatggctctgaaagtcagtagagtttgaatttggtgttaaaggaaatagaacattgaaggctttgagtggaagaatctttaagatggggtaatctggctgnggtgagcagagtggattgggttgggagacaagccagggaactggtgtagtaatccagatggtggtcgggtctagagctcaactagagtagtggtcgatggggttttgaaaatggaaagctacaccaggtttgggagcctgaatatatcgcgtaatggagaaggctgaagggcctgttcactagtagtgtctgtgaccaggtgccttagagagcaggatagccagtaagaagtcactggagctcaggggcgagttagcaccaagactcgaacctcctttttagacccagtgctgggaagcagagccaagtgctgtcttggtggctggaccccattgctagagcgcatcctcacagccagtgaggacaaaatcagagggaaaatgcctgtgctgagccaaggcagagacaantggcgagctcgctcagcatgctcttttgaaggcaagaaggaagatgtctcgggcaccatcttaccctgagtggacctgtttcctttcttgtggcatactgttagctttgatttctctggaagcttttgctttttctgaacctccacgtcccttgctctggtggctgattggactcttcccccacacagggtcatcctcatccttgaacaccacgctgccttcaactagtgcctggtcatccattcgtgcctccaactacaacgttcccctcagcagtacagcacaaagcacttcaggtgggcctcgccttcgctcaggaagggagggttggtcacagccagagccgcggctgttgttttaatgccctcttctttcgtccagtcttctcagggaattaggagattctgtttgtgagcctgggaaattatttttaacatcccttactcctttttaaacttactgtacccagcagtcatctactaaaatcagttttcactgaacagctctcatctcatctcagagccacagcagctctgtaattaaatgtaatttaatccaaactagttctcagactatctgcagcggaggatctttaaa

SEQ ID NO: 326782 - DNA, 1029 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtcttggactagtgttggctgcgtgaggaatggaaagtatagggtgcacgatctacaagattccctaggtaaaatgcacaggtcttggttatcaattggaggtgtcaggaaggaactgtggtgttttgagtatacatctcaagatggtagataatgatgacagttttagcagtggtacgagatatgagaatgtcctgtgaatccgag

SEQ ID NO: 326783 - DNA, 229 bp, Homo sapiens
cacacacacaagtacgtatgtgtatatgttacgtgtgtgtgtgggtatgtatattcacattcagtgagatgatttcagttgtaaaaacttgcaagtaatttataaagaatagcttctataatactaattgtattaactgaaccatcctcttagagtattagtgtaaattggaaagtatttgagagttgcataggattcaggaataaaggttttggatatttattaatgg

SEQ ID NO: 326784 - DNA, 6790 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326785 - DNA, 7060 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtacatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326786 - DNA, 6533 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326787 - DNA, 6802 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326788 - DNA, 3510 bp, Homo sapiens
aactaattttaaatttccgtttccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326789 - DNA, 6130 bp, Homo sapiens
  misc_feature (6119)..(6119): n is a, c, g, or t
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgtcacctcgggatcctctgaacgctatgaccngatacgacccg

SEQ ID NO: 326790 - DNA, 4193 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccaggtatgcctttttaattgagggttagggagtcataataccgacaaagatggtaaaaggaatttgaggagaaaatgaaagcacaagggacaaataagaactgcctgggttattcattattcatactgactccctaattaagtgattttcagtttgaatgttattgccgcccttgcctatcctccgcttacagtgcttatttttttaagggaccagaatcacagctagattttc

SEQ ID NO: 326791 - DNA, 3499 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtacaaaagatacatcttaccaaaaaaa

SEQ ID NO: 326792 - DNA, 2654 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggtaagagaaaattaaatctgtttatattcctcattgagggacacgcacatccatgacatgattctactgaaagagccctgacgtagatcaggacaggggaggctgtgctctccaatagacgtacacatgctgtggttaaatgagtgcatgtgccttgaaag

SEQ ID NO: 326793 - DNA, 101 bp, Homo sapiens
tgtggcttttctagcagagacaagttgcaccctcacttgtgagtgaatgaagccctcctggtgtgctgtcctcacgtgtccgcggtgcctctctcctctag

SEQ ID NO: 326794 - DNA, 439 bp, Homo sapiens
agagtattagtgtaaattggaaagtatttgagagttgcataggattcaggaataaaggttttggatatttattaatggattttaaaatgatgattaagctttgaactaattttaaatttccgtttccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtggtacgtagggggtgcaaatcaatttctgagtgacacttaacacagtttaagaatggctcatgtagtacccagctactctgggcgactgagcccagggtactctgggatcacttgagcccaggagcttgaggcaagcctgggcaacatagttgtgggaccctgtctcttt

SEQ ID NO: 326795 - DNA, 7114 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326796 - DNA, 5479 bp, Homo sapiens
ctgttctagaggacacctcgtatagaggaaggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326797 - DNA, 7045 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326798 - DNA, 3756 bp, Homo sapiens
tccaaacgaaaggtgccaaacgcaacgtaaccaggagaacattgctagagcaactgaccagctggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaatttaaaaaaaaaaatt

SEQ ID NO: 326799 - DNA, 6475 bp, Homo sapiens
  misc_feature (6464)..(6464): n is a, c, g, or t
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattcttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgtcacctcgaggtgaccaaaaaacggtatatcaaggtgtaccatatgatgttttgacatatatataccttgtgaaacgattaccattgtgaaatgattaccattaagtttacatatctgtcacctaaccttgttacctttttttctggtgagaatgctttttatttttaatttttttgagacagagacttgctctgttgcccaggctggagtgcagtggcatgatcacagcgcactgcaacctcacctctctggctcaagaaatcctcctgcttcaaccccccaaggagctgagactacaggcacatgccaccatgcccagctcattgttttgtattttttttttgtcacctcgggatcctctgaacgctatgaccngatacgacccg

SEQ ID NO: 326800 - DNA, 4444 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatttcagatcttttcctgctgaccctttgatttcaaatgtgcagaggggtgtctcggaacaaaagccagaactggaacccatatggaccttgacagagaccaggccttcagccctggcggaactttgcatgaat

SEQ ID NO: 326801 - DNA, 3307 bp, Homo sapiens
tgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgcccctgtggtggtatcggagaaggggatcctatag

SEQ ID NO: 326802 - DNA, 327 bp, Homo sapiens
attttatcaagatcattaacttaccattgtgatcctaaggttccagtttcattgctgaagtatgcaccaaacaacggtggcctgaatccactctttggccctcaacaggtagccatgctgaaccagctatcccagctaaaccagctttctcagatctcccagttacaggtaagcagagtcatagtctttcttagtacacatttatggagcatctactgtatgccaaacactagactctgtgcgggacatagtgcactaaacaaaacaggcgtagtcatagtcctcatggagcttacagtctatcgggggagacagatcgtgaacatt

SEQ ID NO: 326803 - DNA, 7733 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagttctgaggtgggaggatcacctgagcccaggagactgaggctgcagtgaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326804 - DNA, 9020 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcgggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttacccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtgaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagaatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326805 - DNA, 6016 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcgggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttacccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326806 - DNA, 5277 bp, Homo sapiens
tacattggtttgattttgtatttgtagctcagagtcattgttgtctaaatccaactttctaagttagcaaaacaacggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcgggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttacccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtgaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326807 - DNA, 5923 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcgggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttacccttagaacctcggatatcctctatgttttagttttcatttttttaaaatgcttcttaaaattcactaaattgggctaggtgtggctcatgcctgtaatcccagaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326808 - DNA, 3825 bp, Homo sapiens
  misc_feature (1)..(1): n is a, c, g, or t
ngccaacgcttttgattttttcctcggtccaaatatcgggcccggagccttggaatgcccccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttacccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtgaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326809 - DNA, 4332 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgcatgatttatagtcctttgggtatatacccagtaatgggatggctgggtcaaatggtatttccagttctagatcccggaggaatcgccacactgacttccacaatggttgaactagttgacagtcccaccaacagtgtaaaagggttcc

SEQ ID NO: 326810 - DNA, 4017 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagagagcgtcgacgctctctctgtggggcctggggcggcggtgctggaggttgcggcggcggcggcgaaggcgcagcccgaggcggcgggtgggaagaggactgccagaggggcctgcgggagacccaggttcggacccataggagtcctgtggtgaggacctccttgatcgctcttctgcttcggttcccactgaaggaggagcttcggggtgccggctgtgctgcgcggactcctcttggggtccgatgatggatcccagcggg

SEQ ID NO: 326811 - DNA, 7006 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcgggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttacccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtgaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326812 - DNA, 5673 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcgggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttaccctta

SEQ ID NO: 326813 - DNA, 5359 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcgggcagtctacccacctcagccactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtgaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagac

SEQ ID NO: 326814 - DNA, 2683 bp, Homo sapiens
  misc_feature (14)..(14): n is a, c, g, or t
ctgccaggtgaggngcagagagactgttcccttgggtggagaggtgtgggcatgagagccacccattgccaagcagcaagaatgttcgtgcttttttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326815 - DNA, 9123 bp, Homo sapiens
tgaggcctgaggcctggggcgggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgtttacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatctttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcgggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttacccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtgaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaatccgggct

SEQ ID NO: 326816 - DNA, 304 bp, Homo sapiens
agcttaggatgtacaggaatcatctaggaacagctcaagggctaggcatgatctttgtggggctgggatgagctttccagacagaaacgagggagtgtgacacaggtggcagtggaaagaggatgtttgggatgcgagatggggctggaggagtgggcagggaccaggctgggggtgcctttggtgtcctgtttagagggttggtgtctgcctttggagtggtgggaagacactggaggtctctaagggtgcatggggcagggatgggagtagggatccacgatcacatttgtctgtttttttt

SEQ ID NO: 326817 - DNA, 432 bp, Homo sapiens
gcagggaccggtccggaaattcccgggtccgactactactattaaattcgcggccgcgtcgacaagatgttgaaattgttcctgtgcttggtaactactttcctctgccaggctatgggaaagaggatgtaattgtgaataatatacaccatccagtctttaatgtgctgcaacaatgtagtaatttgtttttttcatttgttcccactgcctttgtgtacatagaaaacttaaaaatttcccccagtctattagaagttaagatgttccctaatttattaaatatgcctttattcacaatttgtttttttaggttattcttaatgcattatagaattaagtatgactttgtttatttttattacagtatgtagttattgacatattgtggtttgcagaattatcaattgtataaactaaacctttaaatta

SEQ ID NO: 326818 - DNA, 3986 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaatgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326819 - DNA, 3987 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaatttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326820 - DNA, 3987 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtatttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326821 - DNA, 3855 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326822 - DNA, 2498 bp, Homo sapiens
ctcggtacccggctcatttcagtttgaaaatgtgtgcacagaagagtagctgtgaacaacatctaagttagcacttgtcagtgtacgtttttcaaacgctattttaattatttgtatggtgacaagctgtttgctcaattatgggacttcggggactattctgtcaatcatgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326823 - DNA, 3986 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326824 - DNA, 5695 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcaatatgttgaagcaattttttttaatgttatgttaagtcttaaagagggtggttcactttttgatggtcaaccatttagaagtcttagaactatatttcctcttgtttatacttttaacatagggtttatatgtacattaaatatacttgtgaattagtatttaatggctatttttacaaatatcaactttatgctgatagagcaaatggcatcagtgttacctttaagaaagactaacaacatccagaagatttaaattctcaaacctgtgcctctgttttaggatataagtattatcacaaagtatacttaataaaggctagaaaaatgcttttaaattatggaatctgagatcgttttcagagtgggccatcagaaagaacttagctttatactgtcaaaaaaaggctaagatggtcgagtcattttcattgtgtagtgtacttgcacgtttatttttaggacaaacacatttgaactttatgaatttttttttttttttgcatgtgaaatcttatgaatggctttcattttatacactagaatctgcctcatttactcttaacatatgtttaagtatactggtattaaaacattcaagaaaaggatattgatctaaaatgctacctgagatgcataaacatgtcatcaagtagagaaaatatttttatttttgcccaatattttttagacagtttgattattcttaaaaattgaaaacataagctaaagagatgactaaatggtagattattttgtgtgtgcatgctaggaaaaatgctgttgctttagttttgagctcttcaatgagtctaattgtggtaaggaacaatataaaatcagtttaaagatctttaaaggtagaattttaaataggcatgaaatatagtgagaacttttagtaaacatactacttactctaaaatcaaacattttattttcctaaagaatataggttgccaaaaaatattttatctctaaatataggttagctgtaattatttcatgaatttttttttttttcaatgtaactttttttggtgaagattcatggttcctaagttctgtattcaagtttttgggaaatgtttatttaaaaactgttctatacaagtgttcaaaacattgtatctaaagagagtagcctggacttaaaatatttgaaatcagcttatgcgtgccttttaattttttttttaagtttcttactgccacatatggtgtgaagtgacagtaagttgcttaatgacatcctgcagtatctgcttgcttttggagactccagtgagatgttgaaattgttcctgtgcttggtaactactttcctctgccaggctatgggaaagaggatgtaattgtgaataatatacaccatccagtctttaatgtgctgcaacaatgtagtaatttgtttttttcatttgttcccactgcctttgtgtacatagaaaacttaaaaatttcccccagtctattagaagttaagatgttccctaatttattaaatatgcctttattcacaatttgtttttttaggttattcttaatgcattatagaattaagtatgactttgtttatttttattacagtatgtagttattgacatattgtggtttgcagaattatcaattgtataaactaaacctttaaatta

SEQ ID NO: 326825 - DNA, 1322 bp, Homo sapiens
tgactccttagcagcggagcagcccacggcctgcctgtactgcctgttacatgggccctctggtttgatgtcatcagtggaaatagaagcagggaactgacattctgatttggcatttgcttcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagagaggaagctggcgcgtatggcagccgaggagcacactctgcaggacactggacaagacagaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326826 - DNA, 2022 bp, Homo sapiens
ttgcatatcaacattattgtcaaggtagaaagacaaagcatatttacttaaccatttgtagcctatttataatgttaatatttagacacatagtatgtaggctttcatttgtcttgccctgagtcctaaaaatgttagagggtagatccagccaggtattttctttttttttctttttttctttgatttgtgtaaactgatttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcaatatgttgaagcaattttttttaatgttatgttaagtcttaaagagggtggttcactttttgatggtcaaccatttagaagtcttagaactatatttcctcttgtttatacttttaacatagggtttatatgtacattaaatatacttgtgaattagtatttaatggctatttttacaaatatcaactttatgctgatagagcaaatggcatcagtgttacctttaagaaagactaacaacatccagaagatttaaattctcaaacctgtgcctctgttttaggatataagtattatcacaaagtatacttaataaaggctagaaaaatgcttttaaattatggaatctgagatcgttttcagagtgggccatcagaaagaacttagctttatactgtcaaaaaaaggctaagatggtcgagtcattttcattgtgtagtgtacttgcacgtttatttttaggacaaacacatttgaactttatgaatttttttttttttttgcatgtgaaatcttatgaatggctttcattttatacactagaatctgcctcatttactcttaacatatgtttaagtatactggtattaaaacattcaagaaaaggatattgatctaaaatgctacctgagatgcataaacatgtcatcaagtagagaaaatatttttatttttgcccaatattttttagacagtttgattattcttaaaaattgaaaacataagctaaagagatgactaaatggtagattattttgtgtgtgcatgctaggaaaaatgctgttgctttagttttgagctcttcaatgagtctaattgtggtaaggaacaatataaaatcagtttaaagatctttaaaggtagaattttaaataggcatgaaatatagtgagaacttttagtaaacatactacttactctaaaatcaaacattttattttcctaaagaatataggttgccaaaaaatattttatctctaaatataggttagctgtaattatttcatgaatttttttttttttcaatgtaactttttttggtgaagattcatggttcctaagttctgtattcaagtttttgggaaatgtttatttaaaaactgttctatacaagtgttcaaaacattgtatctaaagagagtagcctggacttaaaatatttgaaatcagcttatgcgtgccttttaattttttttttaagtttcttactgccacatatggtgtgaagtgacagtaagttgcttaatgacatcctgcagtatctgcttgcttttggagactccagtgagatgttgaaattgttcctgtgcttggtaactactttcctctgccaggctatgggaaagaggatgtaattgtgaataatatacaccatccagtctttaatgtgctgcaacaatgtagtaatttgtttttttcatttgttcccactgcctttgtgtacatagaaaacttaaaaatttcccccagtctattagaagttaagatgttccctaatttattaaatatgcctttattcacaatttgtttttttaggttattcttaatgcattatagaattaagtatgactttgtttatttttattacagtatgtagttattgacatattgtggtttgcagaattatcaattgtataaactaaacctttaaatta

SEQ ID NO: 326827 - DNA, 1015 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagagaggaagctggcgcgtatggcagccgaggagcacactctgcaggacactggacaagacaaggaagaacgtgcaaaacgtgaggaagttaaggacaaagaatgggtcatgtcacaagcaaatgtgtcgagagcaaaggcagtccgagccctgaagaacaacagtaatgatatggtaaatgcgattagggttaga

SEQ ID NO: 326828 - DNA, 1740 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326829 - DNA, 4040 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326830 - DNA, 3986 bp, Homo sapiens
agggcattgtgggaagggcggccggtgcagccgcagctgccatcttaggggcgcctggcgctacgggtttctcgttggaggcggccttcgtggcagctgtagacgccgggacgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 326831 - DNA, 4262 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcaaaaaaaaaaaaaaaaaaaaaaaaaaaaaaaaaaaaaaaaaaaaaaaaaaaaaaaaaaaaaaaaaaaaaaaaaaaaaaaaaacttaagggacccgggatccaaaaagcttgatattgaaattctcgccccggggaaaataatccagggcttggggcccccctttagggctttttcccaaaaggtaattttggatgccctaattaacctaagggtctcatggct

SEQ ID NO: 326832 - DNA, 4162 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcaccaatcaacaatactgccatcaacgacaaaaaaactcgagggggggccccgtacccaattcgccctattagggaggcggattacaaattcattggccggcgttttacaacgtggggaatggg

SEQ ID NO: 326833 - DNA, 2985 bp, Homo sapiens
agggcattgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaatttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgattcacctcgagggctggaacccactttcactgctcgctcagccactcgtccgtctgactcacgcgccttccccctaccccgcagctctttctacccc

SEQ ID NO: 326834 - DNA, 2273 bp, Homo sapiens
gtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtacttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaata

SEQ ID NO: 326835 - DNA, 744 bp, Homo sapiens
accaaaggagctcaactgacttgattttacctccccattctggagctttagagaattccaaaaccatagggtgatttgggaacaggtccaaagggcatggcctgggaccaacaaaatgaaaaaagcagcatttctacgatgaatatcaagcaatgtcctggcattcacgaagaccaagatgattgagaaaacttgcaatttgaacaaaatgttttaattgcagtcttcatttatcaagctgttgaaaaaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaata

SEQ ID NO: 326836 - DNA, 408 bp, Homo sapiens
agcaatagttataacaaaataaaaaccaaaaaacacttaaaaatattcagagagttgcgtagaatattctagaatttgtctatatttttgaggttggtgttctagtttcctgatagctggacagccaactcattattgtattgaattgcattaaccattcaaattctctctgcagttacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtaagtccatttggaataaaaaggaaataaatcaaagtattttattctgctaagaagtctgcct

SEQ ID NO: 326837 - DNA, 2330 bp, Homo sapiens
gtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttatccatctttgtgactcttgcgtcatcgtgctacgcattcgcagcctctatcttcactggtgggcgatcagtcttatctctggagcattccatcccttagacgcaacctgcttgcacgggcatcacccggtgagatgtacagatcttgagatctgctactgtgtgtgagagtcatgtagatgtaactggaacgtatagggagctcgggcccagtacacgtgtggatcgatgcactcactcactaatacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtacttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaata

SEQ ID NO: 326838 - DNA, 2159 bp, Homo sapiens
gtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtacttggcttggttgctggaggtctggtgctgttgcttccagaaactaaagggaaagctttgcctgagaccatcgaggaagccgaaaatatgcaaagactgctcatccattctcctgtcttcagtatccatcaaatgctgatgtttctccctctccagacatgagctcaagccccaaagccatctcccaccacccattggacatctttgctcaaactcaacaagtcctggacaagattcatcatttcttccttcccagcttttgccaactggaactgctgaactctgctcttttattcttatccacaaggcctgatcctttctaaagatttaatatcattttcttattttgttttggtctgttttcccccactagaaagtaacttctctgagggcggaggttttttggtttttcttttgtttttaatttactgttgaatcctcattaactaagacagtgcctgacacataacaggtact

SEQ ID NO: 326839 - DNA, 824 bp, Homo sapiens
gtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagatgcccacacacacctgaaagcccgtggaactcaactgaactgtgcctgactgtgtgataggatgtgcttttctctcgatacctattttttctctttaatttcctcaaagtgttcatataaaatcatttggggctggagatcatgctatggcactattattttgttaaaaactacagatgacatcaaaagctatttgtgaagcctgattccaataaatataatagaaaaaaaga

SEQ ID NO: 326840 - DNA, 2520 bp, Homo sapiens
gtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtacttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaatataaagttgtccagaatgtatgtcaagaattttagataggcctttcagtaacacaggtgaagaaatttttaaaaatacattgattattatctaggttagacttaaagtgaatctcaaataaaagaatcaggaatacaacttaagtgatcatgaggtccttccatatttagattgggtaagcatgaatgtgtattttctacaaaagaccttgagaagagttcaataaaaaatgttagcattaaaaaaaa

SEQ ID NO: 326841 - DNA, 2196 bp, Homo sapiens
gtgcacctttgaagtcagctggaccaaggaaaggccctgccctgaaggctggtcacttgcagaggtaaactcccctctttgacttctggccagggtttgtgctgagctggctgcagccgctctcagcctcgctccgggcacgtcgggcagcctcgggccctcctgcctgcaggatcatgcccaccaccgtggacgatgtcctggagcatggaggggagtttcactttttccagaagcaaatgtttttcctcttggctctgctctcggctaccttcgcgcccatctacgtgggcatcgtcttcctgggcttcacccctgaccaccgctgccggagccccggagtggccgagctgagtctgcgctgcggctggagtcctgcagaggaactgaactacacggtgccgggcccaggacctgcgggcgaagcctccccaagacagtgtaggcgctacgaggtggactggaaccagagcaccttcgactgcgtggaccccctggccagcctggacaccaacaggagccgcctgccactgggcccctgccgggacggctgggtgtacgagacgcctggctcgtccatcgtcaccgagtttaacctggtatgtgccaactcctggatgttggacctattccagtcatcagtgaatgtaggattctttattggctctatgagtatcggctacatagcagacaggtttggccgtaagctctgcctcctaactacagtcctcataaatgctgcagctggagttctcatggccatttccccaacctatacgtggatgttaatttttcgcttaatccaaggactggtcagcaaagcaggctggttaataggctacatcctgattacagaatttgttgggcggagatatcggagaacagtggggattttttaccaagttgcctatacagttgggctcctggtgctagctggggtggcttacgcacttcctcactggaggtggttgcagttcacagttgctctgcccaacttcttcttcttgctctattactggtgcatacctgagtctcccaggtggctgatctcccagaataagaatgctgaagccatgagaatcattaagcacatcgcaaagaaaaatggaaaatctctacccgcctcccttcagcgcctgagacttgaagaggaaactggcaagaaattgaacccttcatttcttgacttggtcagaactcctcagataaggaaacatactatgatattgatgtacaactggttcacgagctctgtgctctaccagggcctcatcatgcacatgggccttgcaggtgacaatatctacctggatttcttctactctgccctggttgaattcccagctgccttcatgatcatcctcaccatcgaccgcatcggacgccgttacccttgggctgcatcaaatatggttgcaggggcagcctgtctggcctcagtttttatacctggtgatctacaatggctaaaaattattatctcatgcttgggaagaatggggatcacaatggcctatgagatagtctgcctggtcaatgctgagctgtaccccacattcattaggaatcttggcgtccacatctgttcctcaatgtgtgacattggtggcatcatcacgccattcctggtctaccggctcactaacatctggcttgagctcccgctgatggttttcggcgtacttggcttggttgctggaggtctggtgctgttgcttccagaaactaaagggaaagctttgcctgagaccatcgaggaagccgaaaatatgcaaagaccaagaaaaaataaagaaaagatgatttacctccaagttcagaaactagacattccattgaactaagaagagagaccgttgctgctgtcatgacctagctttgatggcagcaagaccaaaagtagaaatccctgcactcatcacaaagcccatacaactcaaccaaacttacccctgagccctatcaacctaggtctacagccagtggagtctattgtacactgtggaaaaatacccatgggaccagatcctgccaaattcttccagctcactttattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaata

SEQ ID NO: 326842 - DNA, 891 bp, Homo sapiens
gaagcggccttgtgtcacttccggcctccctttagctgccatctttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326843 - DNA, 871 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326844 - DNA, 979 bp, Homo sapiens
cagggggggcgagaaacataggctaggtacgaggctgggtgttttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtagctagttaaaaaaaaaaaactcggggtttttggggggggaaagagtttagaagggcgggcatggtttcggccccttttggaacggtgtg

SEQ ID NO: 326845 - DNA, 728 bp, Homo sapiens
cgattatctctagattaacccaccacaaaaagaaaaaaaaaagcaatgtcgggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326846 - DNA, 736 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttt

SEQ ID NO: 326847 - DNA, 1115 bp, Homo sapiens
  misc_feature (64)..(64): n is a, c, g, or t
  misc_feature (732)..(732): n is a, c, g, or t
tttccaccaatttattcccgcatcaaaccccgacgaaaaaaaaaaccttagggactcctgccanaagtttgaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtaaaaaanaaacaaaacccccaccacacacagcaacccccacaaaacacaaaaaggggggcggcgaaccacatacaagtccgcggacacgccacaaacaacacacccgaccgtctactgcagcggcgtaccacacgcagacgaccataaccaacaagagacgcggataccaaacacgcaggcgggaaaacctcagccgtcgaagccgacgaccaacactgtcggcggacaacggaaccacaccagaacagcacgcgaaaacagatcgtgaggcaccgcccggcgcgaacgctccggcataaaatatcgcgacgacagtaagaacagcagcaaacgcaagaccgagccgataacgcaaccccctaacagtcacacgccacaacacccgcact

SEQ ID NO: 326848 - DNA, 717 bp, Homo sapiens
  misc_feature (462)..(462): n is a, c, g, or t
  misc_feature (473)..(473): n is a, c, g, or t
  misc_feature (475)..(476): n is a, c, g, or t
  misc_feature (479)..(480): n is a, c, g, or t
  misc_feature (483)..(483): n is a, c, g, or t
  misc_feature (508)..(508): n is a, c, g, or t
  misc_feature (516)..(516): n is a, c, g, or t
  misc_feature (526)..(526): n is a, c, g, or t
  misc_feature (530)..(533): n is a, c, g, or t
  misc_feature (537)..(537): n is a, c, g, or t
tcctgctctctgtatctgggttgattttgtctgtcggtgttttgtggggggcacgtggttgcgccgtctggcacgtgcgcgtgggggttccggcgttcggacgctgtggcgggtttttgtcttttttccgggcgatggcgtcgcgtatgtggtggcgtgtgtgtcgtccccgcctgttgttatctgcgcccccacacatgtaggtgggttgctcttcttagagacagttctgcgctgctcgtgtcctgtttttatcctctgccgtcacgtgttgtattagggcccggtcgccgcccgaggtggtctttatgtattataagagagttcgcccttcgattggcgggcgtgccgccgctgtgtatcacaggacactgtggtggtgtcggcgctgcccgggctgctcgcgccccgggcaggggtctcccggcagccccccgcccccgccttttttttttttttttnttttttttttntnnttnnttnttttttttgtttttttttttttttntttttttntttttttttntttnnnntttnaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326849 - DNA, 221 bp, Homo sapiens
cgcggccgcgcgactacggctgcagaagacgacagaaggggaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326850 - DNA, 1158 bp, Homo sapiens
  misc_feature (914)..(914): n is a, c, g, or t
  misc_feature (922)..(922): n is a, c, g, or t
  misc_feature (926)..(926): n is a, c, g, or t
  misc_feature (1155)..(1155): n is a, c, g, or t
gaagcggccttgtgtcacttccggcctccctttagctgccatctttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtaaaaaaacacaaaacacacaaaanaagggggngctnaaaaaacaacagggagcaaaaacggtaacatgtttgtaaagggagcctattaggagataaataacaaaaggagggtaaaaacgagggaggaagaggtgttatgaagcacttggtgtagtaggaacaaaaatgtagaaacaaagtgtgaaaatatgagttgttataataagtaataatgaagtaaaatagaggtaatgcacatgatatatagagtagcaattaggagggnaga

SEQ ID NO: 326851 - DNA, 756 bp, Homo sapiens
gaagcggccttgtgtcacttccggcctccctttagctgccatctttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttt

SEQ ID NO: 326852 - DNA, 688 bp, Homo sapiens
cagcaggtaggaagcgacgtagcgcatccggcggcgtctgcggcggaggcgcggagaagtctcacgcgtgcgacctcggtgttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagtagcaagctctgcccaaacatctgtggatggaaaagcaccacttgctacttcatcatcatcatc

SEQ ID NO: 326853 - DNA, 891 bp, Homo sapiens
  misc_feature (20)..(20): n is a, c, g, or t
  misc_feature (27)..(27): n is a, c, g, or t
  misc_feature (32)..(32): n is a, c, g, or t
  misc_feature (39)..(39): n is a, c, g, or t
ggagagataggctagtacgngccgggnggtgnatcaggncgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326854 - DNA, 890 bp, Homo sapiens
cagggggggcgagaaacataggctaggtacgaggctgggtgttttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326855 - DNA, 888 bp, Homo sapiens
cgcggccgcgcgactacggctgcagaagacgacagaaggggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326856 - DNA, 1535 bp, Homo sapiens
  misc_feature (1535)..(1535): n is a, c, g, or t
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtaaaaaaaaaaaaaaaaacaaacaaaaaaaaaaaaaaaagaaaaaaaaagagaaagaaaaaaaccaagaaaaaagaaaaaaaaaaaaaggggggggggcctaggaacccggggggcgccgcaggatctgacacccccctatgttttcttagaaacagggcgggccctatacaccaagagtcattacaaacgcaagaagcgagcggggcatgcctagaccagggtagcggaagcgcagcaacactggagctgatcacctgtcaggaaagcacccactctcgcgggggggcggaaataatggaggacccaccactggcatatagaacgccgggaggactagaacacgagaggcacgcgtgatgccgaggtcccagcacgccagtgcaggggggcaagcatggggctaagcgcctactcaggcacgaacacacggcgcgcgcacaataaccacggcacaagcgaaaccgagctgggcacaagcaggtctcacaatagcagacaagaccaacagacagcaaagagtgaacggcgcaggaacacacgctgaaacgacacacagaacgcagagacacaccaagcaggcacacgacgcaccagcaacagtaaaccgacagagagcactagaaagagagaaagacaagacacaagcagacagagacaaaaacan

SEQ ID NO: 326857 - DNA, 1042 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtaatacagttttatttttttatttcattgacaccgatctgtacacagtaaaaaaaattgcttatagaaagctaatcatggcatgtaatatggctgataacctttggaatttgattaaagatttaaaatcacggtgtagtgtaacaaaggtggtataaagttctcaggtttgaa

SEQ ID NO: 326858 - DNA, 917 bp, Homo sapiens
  misc_feature (885)..(885): n is a, c, g, or t
  misc_feature (896)..(896): n is a, c, g, or t
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtaaaaaaacaaaagcnaccaataaaanccctcgggctccttggcccta

SEQ ID NO: 326859 - DNA, 1138 bp, Homo sapiens
  misc_feature (894)..(894): n is a, c, g, or t
  misc_feature (902)..(902): n is a, c, g, or t
  misc_feature (906)..(906): n is a, c, g, or t
  misc_feature (1135)..(1135): n is a, c, g, or t
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtaaaaaaacacaaaacacacaaaanaagggggngctnaaaaaacaacagggagcaaaaacggtaacatgtttgtaaagggagcctattaggagataaataacaaaaggagggtaaaaacgagggaggaagaggtgttatgaagcacttggtgtagtaggaacaaaaatgtagaaacaaagtgtgaaaatatgagttgttataataagtaataatgaagtaaaatagaggtaatgcacatgatatatagagtagcaattaggagggnaga

SEQ ID NO: 326860 - DNA, 960 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtagctagttaaaaaaaaaaaactcggggtttttggggggggaaagagtttagaagggcgggcatggtttcggccccttttggaacggtgtg

SEQ ID NO: 326861 - DNA, 1260 bp, Homo sapiens
  misc_feature (877)..(877): n is a, c, g, or t
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtaaaaaanaaacaaaacccccaccacacacagcaacccccacaaaacacaaaaaggggggcggcgaaccacatacaagtccgcggacacgccacaaacaacacacccgaccgtctactgcagcggcgtaccacacgcagacgaccataaccaacaagagacgcggataccaaacacgcaggcgggaaaacctcagccgtcgaagccgacgaccaacactgtcggcggacaacggaaccacaccagaacagcacgcgaaaacagatcgtgaggcaccgcccggcgcgaacgctccggcataaaatatcgcgacgacagtaagaacagcagcaaacgcaagaccgagccgataacgcaaccccctaacagtcacacgccacaacacccgcact

SEQ ID NO: 326862 - DNA, 1153 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtaaaaaaaaaaaccacaaaaaaaaacaaaaagagggtaagcaacaacaaacaaagacggggccgcgcaccaacatacccagggaaggccaagaacatgaccaaccagtttatgaagaaggccccaaggagacatataaaacagcgagggcgcagaaacacacccgagcggaaacggcgccccggccataggagaaccctacggcgggggcacagacccaccaacgaaagacccgcgaaactcgggtgcgaaccctcaccgaggacgtccggaccaatagcgggc

SEQ ID NO: 326863 - DNA, 1112 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326864 - DNA, 890 bp, Homo sapiens
taaacaccttaccggtctcaacgtagccgagagcctccgcgtggttttttatatcctgggcacggaggctctagtgtgtgtcactaaggaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326865 - DNA, 857 bp, Homo sapiens
ccggtggcagcccatgttggggataattacctctgcgattactggttccatatgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326866 - DNA, 1086 bp, Homo sapiens
cagggggggcgagaaacataggctaggtacgaggctgggtgttgaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326867 - DNA, 985 bp, Homo sapiens
caaaggctactaagttaatggtattttctgcacagaaaataccattaacttagtagcctttgcttaaaggtgggattaattctccatgaagtcagaatgagacaataagcagcattaacttcataggcacacagaactagtgctcaaactgctaccacccttttcaattgctatcttttgaaaggcaccactatttgttttgctggggtctcgggtggacccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326868 - DNA, 885 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggataagcctgtgaaccaagagtatatcttcggcgcgtgccgggggggtgggggtggtg

SEQ ID NO: 326869 - DNA, 726 bp, Homo sapiens
  misc_feature (64)..(64): n is a, c, g, or t
tttccaccaatttattcccgcatcaaaccccgacgaaaaaaaaaaccttagggactcctgccanaagtttgaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326870 - DNA, 777 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggagatgatcggttacggaccgcca

SEQ ID NO: 326871 - DNA, 1200 bp, Homo sapiens
cgcggccgcgcgactacggctgcagaagacgacagaaggggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggcaagtatcaaattttgttactttaaaaaacaagatttggctgggaaaagttaacgttaatgcattaaatgggttgttttttttttttaacttagggacttcaaagtccctaagatgtgtttctaccataaattaataaatatcagggagctcattaagtctgaatgctattagaatacatattccattccaggcaaaatttcacctgtgcttcacagtgaaatactagttagccagacttagtttaataaaacatttgtttttaaagagactggtcagcattgctaatttaaatgtttcttttcttaataggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326872 - DNA, 834 bp, Homo sapiens
cgcggccgcgcgactacggctgcagaagacgacagaaggggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaagtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326873 - DNA, 998 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaagtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326874 - DNA, 882 bp, Homo sapiens
ggatatcaccagtggtccggccggcgcaggccctgaacgtcaagtcgataatgccccgtagcggctcccctatgcagatccgtggaacgaatggaaatagatgaccaaggcatgcatcacacagataaaacatcggcccgagggaagccgaacgtgtcccgataggatggttccagaagtggcggtcctcgacggatcagtaacagggatgcgtatcaaacaagagcaggccaccagcgagactgcagcagtatcaacattcacgcgcccgctccaaggaagctacggggtaaacacagatctctgcgtattggaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326875 - DNA, 808 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaacactgcagctcttttcagtttttgcttatacacaattcattctttgcagctaattaagccgaagaagcctgggaatcaagtttgaaacaaagattaataaagttctttgcctagta

SEQ ID NO: 326876 - DNA, 898 bp, Homo sapiens
  misc_feature (751)..(751): n is a, c, g, or t
  misc_feature (762)..(762): n is a, c, g, or t
  misc_feature (764)..(765): n is a, c, g, or t
  misc_feature (768)..(769): n is a, c, g, or t
  misc_feature (772)..(772): n is a, c, g, or t
  misc_feature (797)..(797): n is a, c, g, or t
  misc_feature (805)..(805): n is a, c, g, or t
  misc_feature (815)..(815): n is a, c, g, or t
  misc_feature (819)..(822): n is a, c, g, or t
  misc_feature (826)..(826): n is a, c, g, or t
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagattctattaaatttcttttatatttttcgccctctcccttttgactttcaagttttttttnttttttttttntnnttnnttnttttttttgtttttttttttttttntttttttntttttttttntttnnnntttngacaaatttattgaaacatacaggcggctgttagcagagaaatcattccatgattcgatgtgttacattggc

SEQ ID NO: 326877 - DNA, 737 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttttttttgtgcgggggggaaaaaaaaaaaagggggaataaaaacctgaaagaaaaggtttttaaaacccctttggggggggggcgggaaaagggcccttttggggcgttta

SEQ ID NO: 326878 - DNA, 834 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccaatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326879 - DNA, 871 bp, Homo sapiens
  misc_feature (835)..(835): n is a, c, g, or t
  misc_feature (839)..(839): n is a, c, g, or t
  misc_feature (841)..(842): n is a, c, g, or t
  misc_feature (845)..(846): n is a, c, g, or t
  misc_feature (849)..(851): n is a, c, g, or t
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccaatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtanaaananngannaannnaactcgagactagttctctc

SEQ ID NO: 326880 - DNA, 813 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326881 - DNA, 977 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttt

SEQ ID NO: 326882 - DNA, 1049 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaacactgcagctcttttcagtttttgcttatacacaattcattctttgcagctaattaagccgaagaagcctgggaatcaagtttgaaacaaagattaataaagttctttgcctagta

SEQ ID NO: 326883 - DNA, 470 bp, Homo sapiens
atgggttgaccgtggcttgtgggttgaccgtggcttgtgggttgaccgtggcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 326884 - DNA, 369 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggttatgctacttttgtgtcattctgttcacgctgacattttgtgtgtgtagtgttcttttccctcttctgctttcgaatttttttttctctctgttacgttcctctttttttctgtttctttttcttcttttttactg

SEQ ID NO: 326885 - DNA, 385 bp, Homo sapiens
tcccattttttgcttctatcttcgccttagcctgcctgctcactgcataagtttatgattatggtaatgttcttatacagatccaaaggtcagaaatgaattggaaactattcccatttgaaaaatatctgttgtggtataaatgtgctgttttctttcctcttctccctgactttaggaactgctcgcagaaagaagaaggtggttcatagaacagccacagcagatgacaaaaaacttcagttctccttaaagaagttaggggtaaacaatatctctggtattgaagaggcaagtatcaaattttgttactttaaaaaacaagatttggctgggaaaagttaacgttaatgcattaaatgggttgttttttttttttaactta

SEQ ID NO: 326886 - DNA, 569 bp, Homo sapiens
gggctgcaggaattcggcacgaggttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgacgctgttgctctgtggagagtgtggccttgtctcggccttggaacaggctttcagcatggatttaaatcgcccgctctcaaaatgcttcattgggatt

SEQ ID NO: 326887 - DNA, 2374 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaataccaccaccacacccacccccccccacaccctttccgccccccccgccccccgaaaacgcctcctaacaccatctcgctcgggcgcgacggccccacatcggcactcgaccccggcccaacacctggccccaagggacacatcccggtctcgcagccccgcgcgccggcgttctccgcacacattaaaaacaaaggccccggggcaaccccgcgctctttccgaccacactccccataagggccactcccgagaggacactaacggcgcttcaccaccagcggcccccaggcactccattaccacattcccccgcccccag

SEQ ID NO: 326888 - DNA, 2418 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcaggttagtaggtgtccctgccacagggaagaagtaagaactggcaaaggcatggaagagtagtgccagggagaatatagaaagtgacctgcagcattatttataacggaggggacacagggatatgatttattccacagttaagtggtctgacggagccgagtctccaattgtaggctctacggaaatgaacttgctggtcctgcccaggcaaatgggcttagttccctatttatttatcctccagcaacagaactgagttcactcggtatctgaaattgacttttccagcagaaagtttttgtgggtatgggcactggccttggctttgagcaagcttgatgaatgttggatatttctggatttcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326889 - DNA, 1994 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatttgccaacagttgtatgtttgctgattatttatgacctgaaataatatatttcttcttctaagaagacattttgttacataaggatgacttttttatacaatggaataaattatggcatttctattgaaa

SEQ ID NO: 326890 - DNA, 2758 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcaggttagtaggtgtccctgccacagggaagaagtaagaactggcaaaggcatggaagagtagtgccagggagaatatagaaagtgacctgcagcattatttataacggaggggacacagggatatgatttattccacagttaagtggtctgacggagccgagtctccaattgtaggctctacggaaatgaacttgctggtcctgcccaggcaaatgggcttagttccctatttatttatcctccagcaacagaactgagttcactcggtatctgaaattgacttttccagcagaaagtttttgtgggtatgggcactggccttggctttgagcaagcttgatgaatgttggatatttctggatttcagggtggcccggtggaaatcctgccctttctgtacctgggcagtgcgtatcacgcttcccgcaaggacaaccacaaggcagacatcagctcctggttcaacgaggccattgacttcataggtaaatggaatggatgcctggggcttttctgcctttctcttctcattttagccactaagcccaacctctgtggcaagagcttgaagttttctgagccttcttccacacattcagtatcagtctggtgtgggcaacattcctgtaaaatatgaatttgattcgatgtcccactttacagatttgcaaagtggggctcacaaagttgaattgactggtctgagatctatctgctaagtggaaatccccagtctgagtttaaatcctgtgccatcctttgcacagtgcccacgttgcctccatgaacagtatccatgtgatggcatgtggtgatgttgaccatttctagacaagacacacatgacctttctcagatacactgtacctgggcttggggtggttctcctgaactctcaagtaaccagccgctcctttggttttccagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326891 - DNA, 1968 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgatccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326892 - DNA, 1463 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccg

SEQ ID NO: 326893 - DNA, 996 bp, Homo sapiens
acaatcaggaagtagaaactggggctttactgaaaaccaaggtctggaagatgggatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326894 - DNA, 2052 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326895 - DNA, 2244 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaaaaaaaaaaaaaaaaaaaaaaaaaaaaaaagagggggcggcgcgcgccctcaagaatatattcccccgccgagggggccccaagttatagcgcggttccccggttttcttggttcacaagggggccccctaaagagggggacggaattaaaagggcaaggcaacgggcccgggttaaaaaggcgggaacggga

SEQ ID NO: 326896 - DNA, 2486 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaattcaacgcttttatttctttggcaaccacacccaatccctctcccactagtgaactagggaagaatttcgacaagggcctgcagaatgtgttgagatctgatcccatgccctgtggtggcccgttggtcccatgaaatggctgggttgcaagggaggaagacaagtgagtatcatgaaacaccggacgctacagctgaactcttagtattggatcagtgtgtctgcccatgcccattttagcggctctgtaacctaccatgtcacccaggatgccaaggtgtccccagagccaaagctaggaggaaatagccacttgtctggattgccttcttcatttaataccctcctcaggttaatataaaaagtcgccttcccatctctgagctgtgctggagttatgaggagacaaaagtttttccaaacacatgacata

SEQ ID NO: 326897 - DNA, 2331 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggtacgccctcggggaagctcggggcgggccgcacacccctgaggttttgcccggtacccctggctctcggctcccgggggatcgccccacctgcagcgcgtgggcgctggagtacatttatctctggaacttgtcattggctttgtttggctctggaaacaaagacttgcctgggcctttccgatgtaaacttccagcccttggtgggtgggggagttgtatgaaggtgccgtgtcccggtgtcactaatggggaaaaaaaatgtctttgtattcccaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326898 - DNA, 2494 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcataggtaaatggaatggatgcctggggcttttctgcctttctcttctcattttagccactaagcccaacctctgtggcaagagcttgaagttttctgagccttcttccacacattcagtatcagtctggtgtgggcaacattcctgtaaaatatgaatttgattcgatgtcccactttacagatttgcaaagtggggctcacaaagttgaattgactggtctgagatctatctgctaagtggaaatccccagtctgagtttaaatcctgtgccatcctttgcacagtgcccacgttgcctccatgaacagtatccatgtgatggcatgtggtgatgttgaccatttctagacaagacacacatgacctttctcagatacactgtacctgggcttggggtggttctcctgaactctcaagtaaccagccgctcctttggttttccagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326899 - DNA, 1860 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326900 - DNA, 1998 bp, Homo sapiens
gaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcggatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326901 - DNA, 1820 bp, Homo sapiens
  misc_feature (61)..(61): n is a, c, g, or t
  misc_feature (78)..(78): n is a, c, g, or t
  misc_feature (83)..(83): n is a, c, g, or t
gcagcacatatactaaaattggaacgatacagagaagattagcatggcccctgcgcaaggntgacacgcaaattcgtnaagcnttccatattttaaaacagtcgacccccatggggctcagccttcccctgagtactagcgtccctgacagcgcggaatctgggtgcagttcctgcagtaccccactctacgatcaggttagtaggtgtccctgccacagggaagaagtaagaactggcaaaggcatggaagagtagtgccagggagaatatagaaagtgacctgcagcattatttataacggaggggacacagggatatgatttattccacagttaagtggtctgacggagccgagtctccaattgtaggctctacggaaatgaacttgctggtcctgcccaggcaaatgggcttagttccctatttatttatcctccagcaacagaactgagttcactcggtatctgaaattgacttttccagcagaaagtttttgtgggtatgggcactggccttggctttgagcaagcttgatgaatgttggatatttctggatttcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaa

SEQ ID NO: 326902 - DNA, 328 bp, Homo sapiens
atgtatatgtgtgatattagttcacagaaaaatgtgaaaattcaagtggtaatgaattatctggtgaagatattacagtatttatgtctaaccatgttcttactttcctaaatatttgttgccttcataatttttaaaagctgcttgtaaggcttttataattgattaaagtgatttgttattattgataaatttatgtttaaaaaggcatttaaatcaacaaatattgattgagcacttatgtgacacactgttcttaatgctgaggaatgcattagtgtataaaaagtttgaaaagttaatgaaaataagtagagtgaggtgatag

SEQ ID NO: 326903 - DNA, 2194 bp, Homo sapiens
  misc_feature (2)..(2): n is a, c, g, or t
  misc_feature (4)..(4): n is a, c, g, or t
gngngcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgt

SEQ ID NO: 326904 - DNA, 603 bp, Homo sapiens
ggctccattgtcttccccttgggccagcactaccacagaatgtcttaggattcagctccagggccgccacgcctgcttctttcagggagctggttctatgcacatgttttatatgagagataattaagttgtcaattgtgataacaaaacaggatttgactttgtacagaattctttggttccaaccaagctcatttcctttgtttcagcaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaaggtgagcattttttaatttgtttttatgacctgttttaaattgtgaatacttgggttttacaacccatttcttccccaattcaaaaatagcagaacagagttgttgagaaggtgatggagtagaagggggagcgcgcactgtggggaggggtggacaacaggcctggtcctacctgtgactctgcactaccctgtgactctgggcagggccccctc

SEQ ID NO: 326905 - DNA, 2689 bp, Homo sapiens
  misc_feature (2)..(2): n is a, c, g, or t
  misc_feature (4)..(4): n is a, c, g, or t
gngngcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggtttgggtagaggcaatccaaaagggctggattgctgcttagattggagcaggtacaacgttgtgcatgccccgtatttctacgaggtgttcgggacggcgtagagactgggacctgctgcgtactggcaaagcagaccttcataagaaataatcctgatccaatacagccgacggtgtgacaggccacacgtccccgtgggtctctgtggaagtttcagtgtagcgacatttcagataaaagtggaaaaagtgaagtttggcttttttcatttgtatgcagtcctaactcttgtcacacgtgtgggatttatctttttccataacttactgaaaacccttcctggcgggctgaacctgactcttcctgagctgagtcctggactggcacactgatggctctgggctcttcccggtcaagttataacaaggctttgcccatgaataatttcaaacgaaaatgtcaagatccttgccggtgtcctgggattacaaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgt

SEQ ID NO: 326906 - DNA, 1823 bp, Homo sapiens
ggctccattgtcttccccttgggccagcactaccacagaatgtcttaggattcagctccagggccgccacgcctgcttctttcagggagctggttctatgcacatgttttatatgagagataattaagttgtcaattgtgataacaaaacaggatttgactttgtacagaattctttggttccaaccaagctcatttcctttgtttcagcaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgt

SEQ ID NO: 326907 - DNA, 892 bp, Homo sapiens
ctctggtatctactttgagggttgaaatagggggcctgaccccaggtgaatgtggctgccttcccagagcccccatttgcaagaccctccagacccccaggtgcttctgcttgtgtcttttgtggcaccaggcaagaatgtagcagcgtcagcagcccctctggtgactgtggcatggttgacattcatttcccccctaattaatggcatcctcatgattctcttttatattaatagttcttgagtttttttgtaagctacttcaaatcctttgttggtgcaagatagaagatattttatgtgtttgttttgcatgtgcacacacatatttggcctttgaattcctgacctcagttgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgt

SEQ ID NO: 326908 - DNA, 702 bp, Homo sapiens
  misc_feature (17)..(17): n is a, c, g, or t
  misc_feature (32)..(32): n is a, c, g, or t
  misc_feature (41)..(41): n is a, c, g, or t
  misc_feature (71)..(71): n is a, c, g, or t
  misc_feature (192)..(192): n is a, c, g, or t
  misc_feature (195)..(195): n is a, c, g, or t
caacttaacactgtacngtcacacaatgtacnttcaccacntgtattatctatcatttgtttccatctgtnaatctgacaccataccctcctttgaatcttttgagattccttctgtaactctcagttgttcattcttcttttgcctgtcccttaaaaagttgtatttcttggggtacctgagatgtatttngtnctacatgttaaatagggcacaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgt

SEQ ID NO: 326909 - DNA, 974 bp, Homo sapiens
  misc_feature (2)..(2): n is a, c, g, or t
  misc_feature (4)..(4): n is a, c, g, or t
gngngcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaaggtgagcattttttaatttgtttttatgacctgttttaaattgtgaatacttgggttttacaacccatttcttccccaattcaaaaatagcagaacagagttgttgagaaggtgatggagtagaagggggagcgcgcactgtggggaggggtggacaacaggcctggtcctacctgtgactctgcactaccctgtgactctgggcagggccccctc

SEQ ID NO: 326910 - DNA, 1454 bp, Homo sapiens
  misc_feature (2)..(2): n is a, c, g, or t
  misc_feature (4)..(4): n is a, c, g, or t
gngngcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggtttgggtagaggcaatccaaaagggctggattgctgcttagattggagcaggtacaacgttgtgcatgccccgtatttctacgaggtgttcgggacggcgtagagactgggacctgctgcgtactggcaaagcagaccttcataagaaataatcctgatccaatacagccgacggtgtgacaggccacacgtccccgtgggtctctgtggaagtttcagtgtagcgacatttcagataaaagtggaaaaagtgaagtttggcttttttcatttgtatgcagtcctaactcttgtcacacgtgtgggatttatctttttccataacttactgaaaacccttcctggcgggctgaacctgactcttcctgagctgagtcctggactggcacactgatggctctgggctcttcccggtcaagttataacaaggctttgcccatgaataatttcaaacgaaaatgtcaagatccttgccggtgtcctgggattacaaggcactacaaatactgtggcagcatataatttaacttggaaatcaactaatttcaagacaattttggagtgggaacccaaacccgtcaatcaagtctacactgttcaaataaggtaagctgggtacagaaaaagaaaattaaggtcttggatgtttctactgtcctatgctgaacaagaatgtctttaaagctgattactggatgaaattatttaacagatgacgaagaagaagggattctgggcaattcgctggccggtgtcatactctattaggcctgcaacatttccagaccttaaacggatagaacattttaatggttttaatggttttgggaaatgatgggagagttcctaagtggagtataaactgtggagagatgaaccatcttgagtaggcactgaagtgtgcttggggtcatgatagattaattaatctcatctaaacatggatgtctttttctgtggctgtctagactgtgaacaatgtctaacaccttagggaagaggtggggaggaatcccaatgtatacattacccttaagcagtgtttgattcattcatctttggactccatgaatcgaaatctggtagaatacatgatcttagtggaggaggccaaatgcgtgactcactgagcctggcagagcagaaatactctgctgtctgcaccctctgggtctggtgtggctc

SEQ ID NO: 326911 - DNA, 669 bp, Homo sapiens
cccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggtgagtggcaccagcccctggaagcccggggcgcgccacacgcaggagggaggcgacagtcctggctggcagcgggctcgccctggttccccggggcgcccatgttgtcccccgcgcctacgggactcggctgcgctcacccagcccggcttgaatgaaccgagtccgtcgggcgccggcgggagttgcagggagggagttggcgccccagaccccgctgccccttccgctggagagttttgctcggggtgtccgagtaattggactgttgttgcataagcggacttttagctcccgctttaactctggggaaagggcttcccagtgagttgcgaccttcaatatgataggacttgtgcctgcgtctgcacgtgttggcgtgcagaggtttggatattatctttcattatatgtgcatcttcccttaataaagagcgtccctg

SEQ ID NO: 326912 - DNA, 2339 bp, Homo sapiens
  misc_feature (2)..(2): n is a, c, g, or t
  misc_feature (4)..(4): n is a, c, g, or t
gngngcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgtactgttgtacttattctatcttccatttattatttatgtacaatttggtgtttgtattagctctactacagtaaatgactgtaaaattgtcaaaaaaataaatatattaaataaatactggccgtcgtttaccgtcgtgctgggt

SEQ ID NO: 326913 - DNA, 2034 bp, Homo sapiens
  misc_feature (2)..(2): n is a, c, g, or t
  misc_feature (4)..(4): n is a, c, g, or t
gngngcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgt

SEQ ID NO: 326914 - DNA, 1378 bp, Homo sapiens
  misc_feature (2)..(2): n is a, c, g, or t
  misc_feature (4)..(4): n is a, c, g, or t
gngngcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatgtttctaagccccaaaaccccatgggtttttctttgtgtttcgttttgttttttaaaaaataacagtgggcgctcgtaggag

SEQ ID NO: 326915 - DNA, 692 bp, Homo sapiens
  misc_feature (2)..(2): n is a, c, g, or t
  misc_feature (4)..(4): n is a, c, g, or t
gngngcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagagtaagtggcttgggctgtaataccgttcattcttgttagaaacgtctgaacattctcgtgatcttgtgcctttaggggctacaaaattaaaaatatttattctttttttctc

SEQ ID NO: 326916 - DNA, 3345 bp, Homo sapiens
cagagtatctttttctatgtgttccatgtatttgtgtctttggagctatagtctcttgtagacagcatatcactatctgtttgttttgttttgttttttctgtccattctgccaatttctgccttttgattggaaaatttaatccatttgcatttaaagtaattaaggaaggactttcttctaccatttaacacttcttctatatgtcatatacttttttggcccctcatttcctctttatggccttcttttctgtttttttgtagtgaactagtctgattctctttccactcccctttgtgtatatttgttagatgttttatttgtggttgctatggggattatagttaacatcctacacttaaaacaatctaatttaaactgataccaatttaccttcaatagcatacaaaatctctactcctgtaaagctctgcccctgccccccttatgttattgatggcacaaattgcctaataaataatttatagttatttgtatgagtttgtcttttaaatcatttaggaaataaaaagtggagttagaaaacagtatgatagtaatactgacttttatatttgtcaatatatttatcttattttggatccttatttcattatatagatttgagttactgtctagtgcccttccatttcggcccaaaggattcccttatgcatttcttgcagggcaagtctaattgtaataaactccctcagcttttgttttatctgagaatgtcttgatttctcccttatttttgatggataattttgccagatacatgaatttttggtaacagtatttttctttcagcactttaaatatgtcatcccactaccttctgacttcatggtttctcatgagatattagatgttataaaatttgaggattcctcattcttgatgagtcagttctgtcttattgcttttcggatttgctcagcttttgtcttttgacagtttgattataacgcggctcagtgtgggtctctgagtttatcccacttagagtttgttgagtttcttggagtcatagatttatgtcttttatcaaattttggacatatttggctattatttcttcaatttttttcactgcttctttcttttccttctgaaatattcttaatgtatatgttggtctgtttgatgctgtctcaccagtttcttaggctgtgttctctttgttcctcagacttgattattgcagttgcccttctttttatttttttcaagtttgttgattcttctccctgttcagatcaactgttgaactcctctagtgaatttatttcagttactgtacttttcagctccaagatttatctttggttcctttttataacgtctgtgtctttattgatattctcattttgttcatatgtctctttcttcctttagttctttgtccatgttttcctttagctctttgggcttatttaagacaattgtttaaagtctttgcatagtaagtccaatgtctgtgtttcttcagggatggttttcattattttgttttcaatgagccatactttcctgtgtctttgtatgctgtctttttgttgttgaaaactgtatgtttgaacatcataacgtggtggccctgaaaatcagatattccccccttcctgagagttagttttatttttattattgaagattgtagcagtctattgctacatgtgcagtcatttccaaactatttttgcaaagactgtattccttctgtgtgtcatcactgaagtctctgttccttagtttgtgtttaatagtttgacatagatttccttgaaaggagttaaaactagcagaaaaatctctctcccagtctttccagtctttgtagattggttctgtgctgggcttttccattaatacttagccaggcttgtactgagcctaacaatcaggcccaaaagcgtagggtctttgcagatcttgtctgagcatgcttcttgctgtgtatgcacgtagttttctaaatctccctgtatgtgctgttgaatattctaatttcccaaagaaactcctttgcagctttttctcacagaacatagatggttttttggatatcttgaccatagtctttcgacccaggtgtttgcggttgttagttcaccttacacttttttcaagcattgcctactgcttacgatgagtgctctgtcactcctttaagtagccccagacaggctaccagagacttaaacaagaatttgtaagttctgctcagcttcctctagaaatggggatcagggtccaagacagaatgcagttgctgatttcaagactgctgcaacaccagggagcttgtgggggaagggcaagcagaaatgtcacaaagctttcttgccattttaaagttgcctgttcttgactcagcatttgcttcattgctataaactttttactgtttttcagagttctgataaaattggctatgcctgttcctgctttaaaaaatatatatatattttttagggattggggtctcactatactgaccaggctggtcttgaacttctggcctcaagccatcctctcatttcagcttcccaaagtgctgcaattacacgcgtgaaccaccacacccagcccctgcttgtttttcaatgtgcctactccaccatgttgctcaagtatgtatattttctaaactaccttgtagtgttgtgatgggaaataaatccctgagccttttgaataactcagagagatcaaaaacttagtttatcctattcgaaggattagaaaaatgatatatctttcactttttcagggataggctcctcattagaaggctcctatgtgccgatgctgtacaagacatttcatttctcttaatgtttacaacaagcttgttgccaaggctgatcttgaactcctggcctcaaacgatcctcccagctcagtctcacaaagtgttgggatgtctggccaactaatgactatcttaactcttgtgtttcaatgtttatgccttcttttatcttgactgattgtatgactatgtcttctagaacaatgttgaacagaaatggtgagagcagacatccttgctttaatatttcaccattatatatgatgttaggtatagatttttctcacagatgccttttatcagattgaggaatttatattcctactttgccgaaaggtttttgtagtatgagggggtgctgaattttgtcaaacactttttcggtaataattgagatgattggttctgcagtcatcgagatgtggattttctcctttattctgttcgtgagtgattacactggttgactaatgttaaaacaaccttactttccaggaataaaccctattatcttttttata

SEQ ID NO: 326917 - DNA, 4039 bp, Homo sapiens
cagagtatctttttctatgtgttccatgtatttgtgtctttggagctatagtctcttgtagacagcatatcactatctgtttgttttgttttgttttttctgtccattctgccaatttctgccttttgattggaaaatttaatccatttgcatttaaagtaattaaggaaggactttcttctaccatttaacacttcttctatatgtcatatacttttttggcccctcatttcctctttatggccttcttttctgtttttttgtagtgaactagtctgattctctttccactcccctttgtgtatatttgttagatgttttatttgtggttgctatggggattatagttaacatcctacacttaaaacaatctaatttaaactgataccaatttaccttcaatagcatacaaaatctctactcctgtaaagctctgcccctgccccccttatgttattgatggcacaaattgcctaataaataatttatagttatttgtatgagtttgtcttttaaatcatttaggaaataaaaagtggagttagaaaacagtatgatagtaatactgacttttatatttgtcaatatatttatcttattttggatccttatttcattatatagatttgagttactgtctagtgcccttccatttcggcccaaaggattcccttatgcatttcttgcagggcaagtctaattgtaataaactccctcagcttttgttttatctgagaatgtcttgatttctcccttatttttgatggataattttgccagatacatgaatttttggtaacagtatttttctttcagcactttaaatatgtcatcccactaccttctgacttcatggtttctcatgagatattagatgttataaaatttgaggattcctcattcttgatgagtcagttctgtcttattgcttttcggatttgctcagcttttgtcttttgacagtttgattataacgcggctcagtgtgggtctctgagtttatcccacttagagtttgttgagtttcttggagtcatagatttatgtcttttatcaaattttggacatatttggctattatttcttcaatttttttcactgcttctttcttttccttctgaaatattcttaatgtatatgttggtctgtttgatgctgtctcaccagtttcttaggctgtgttctctttgttcctcagacttgattattgcagttgcccttctttttatttttttcaagtttgttgattcttctccctgttcagatcaactgttgaactcctctagtgaatttatttcagttactgtacttttcagctccaagatttatctttggttcctttttataacgtctgtgtctttattgatattctcattttgttcatatgtctctttcttcctttagttctttgtccatgttttcctttagctctttgggcttatttaagacaattgtttaaagtctttgcatagtaagtccaatgtctgtgtttcttcagggatggttttcattattttgttttcaatgagccatactttcctgtgtctttgtatgctgtctttttgttgttgaaaactgtatgtttgaacatcataacgtggtggccctgaaaatcagatattccccccttcctgagagttagttttatttttattattgaagattgtagcagtctattgctacatgtgcagtcatttccaaactatttttgcaaagactgtattccttctgtgtgtcatcactgaagtctctgttccttagtttgtgtttaatagtttgacatagatttccttgaaaggagttaaaactagcagaaaaatctctctcccagtctttccagtctttgtagattggttctgtgctgggcttttccattaatacttagccaggcttgtactgagcctaacaatcaggcccaaaagcgtagggtctttgcagatcttgtctgagcatgcttcttgctgtgtatgcacgtagttttctaaatctccctgtatgtgctgttgaatattctaatttcccaaagaaactcctttgcagctttttctcacagaacatagatggttttttggatatcttgaccatagtctttcgacccaggtgtttgcggttgttagttcaccttacacttttttcaagcattgcctactgcttacgatgagtgctctgtcactcctttaagtagccccagacaggctaccagagacttaaacaagaatttgtaagttctgctcagcttcctctagaaatggggatcagggtccaagacagaatgcagttgctgatttcaagactgctgcaacaccagggagcttgtgggggaagggcaagcagaaatgtcacaaagctttcttgccattttaaagttgcctgttcttgactcagcatttgcttcattgctataaactttttactgtttttcagagttctgataaaattggctatgcctgttcctgctttaaaaaatatatatatattttttagggattggggtctcactatactgaccaggctggtcttgaacttctggcctcaagccatcctctcatttcagcttcccaaagtgctgcaattacacgcgtgaaccaccacacccagcccctgcttgtttttcaatgtgcctactccaccatgttgctcaagtatgtatattttctaaactaccttgtagtgttgtgatgggaaataaatccctgagccttttgaataactcagagagatcaaaaacttagtttatcctattcgaaggattagaaaaatgatatatctttcactttttcagggataggctcctcattagaaggctcctatgtgccgatgctgtacaagacatttcatttctcttaatgtttacaacaagcttgttgccaaggctgatcttgaactcctggcctcaaacgatcctcccagctcagtctcacaaagtgttgggatgtctggccaactaatgactatcttaactcttgtgtttcaatgtttatgccttcttttatcttgactgattgtatgactatgtcttctagaacaatgttgaacagaaatggtgagagcagacatccttgctttaatatttcaccattatatatgatgttaggtatagatttttctcacagatgccttttatcagattgaggaatttatattcctactttgccgaaaggtttttgtagtatgagggggtgctgaattttgtcaaacactttttcggtaataattgagatgattggttctgcagtcatcgagatgtggattttctcctttattctgttcgtgagtgattacactggttgactaatgttaaaacaaccttactttccaggaataaaccctattatcttttttatacattgctggatttgatttgctaattattttaaggacttttatttctacattcatgatagatactgctggtattttctcatgatgtcttttgcaggatttgtatcatatatggcatttctgaggtatacctaagtatcatttattcaaggacctaagaaatggaaaaatcaattgaggtgatttttccatcatgaaaaaaatttctttaaagtcatctgtctgattctgtaaaaatttcacattctttatgtgaacaaaaagctgaaagaaattcagggaaagaattaagatgtgatatcaattgccaacccaatgttttgttcttgctagttgtgttccccctccttattccatccatttcatagtaataagaaaaaaaagaattttacattgagatttttaggtaaatttttgaattacagtatatgataaaaaccttaacgttcaaactccaggtataatgaaatttaattgaaaattactatagcagtttaagtcaatttgtagttttgaaagcagttttaatattttatcttccacaaaaaggtaggaaagtttctgtgctgaacttaaatatataaaggaacacgtccaacatatttagttaaaaatccaaaagtcagaggataatttccaaatgtgtacttaaatagaaaaaaattacaaatttcatgtgcaataaagtgtctgccac

SEQ ID NO: 326918 - DNA, 4835 bp, Homo sapiens
cagagtatctttttctatgtgttccatgtatttgtgtctttggagctatagtctcttgtagacagcatatcactatctgtttgttttgttttgttttttctgtccattctgccaatttctgccttttgattggaaaatttaatccatttgcatttaaagtaattaaggaaggactttcttctaccatttaacacttcttctatatgtcatatacttttttggcccctcatttcctctttatggccttcttttctgtttttttgtagtgaactagtctgattctctttccactcccctttgtgtatatttgttagatgttttatttgtggttgctatggggattatagttaacatcctacacttaaaacaatctaatttaaactgataccaatttaccttcaatagcatacaaaatctctactcctgtaaagctctgcccctgccccccttatgttattgatggcacaaattgcctaataaataatttatagttatttgtatgagtttgtcttttaaatcatttaggaaataaaaagtggagttagaaaacagtatgatagtaatactgacttttatatttgtcaatatatttatcttattttggatccttatttcattatatagatttgagttactgtctagtgcccttccatttcggcccaaaggattcccttatgcatttcttgcagggcaagtctaattgtaataaactccctcagcttttgttttatctgagaatgtcttgatttctcccttatttttgatggataattttgccagatacatgaatttttggtaacagtatttttctttcagcactttaaatatgtcatcccactaccttctgacttcatggtttctcatgagatattagatgttataaaatttgaggattcctcattcttgatgagtcagttctgtcttattgcttttcggatttgctcagcttttgtcttttgacagtttgattataacgcggctcagtgtgggtctctgagtttatcccacttagagtttgttgagtttcttggagtcatagatttatgtcttttatcaaattttggacatatttggctattatttcttcaatttttttcactgcttctttcttttccttctgaaatattcttaatgtatatgttggtctgtttgatgctgtctcaccagtttcttaggctgtgttctctttgttcctcagacttgattattgcagttgcccttctttttatttttttcaagtttgttgattcttctccctgttcagatcaactgttgaactcctctagtgaatttatttcagttactgtacttttcagctccaagatttatctttggttcctttttataacgtctgtgtctttattgatattctcattttgttcatatgtctctttcttcctttagttctttgtccatgttttcctttagctctttgggcttatttaagacaattgtttaaagtctttgcatagtaagtccaatgtctgtgtttcttcagggatggttttcattattttgttttcaatgagccatactttcctgtgtctttgtatgctgtctttttgttgttgaaaactgtatgtttgaacatcataacgtggtggccctgaaaatcagatattccccccttcctgagagttagttttatttttattattgaagattgtagcagtctattgctacatgtgcagtcatttccaaactatttttgcaaagactgtattccttctgtgtgtcatcactgaagtctctgttccttagtttgtgtttaatagtttgacatagatttccttgaaaggagttaaaactagcagaaaaatctctctcccagtctttccagtctttgtagattggttctgtgctgggcttttccattaatacttagccaggcttgtactgagcctaacaatcaggcccaaaagcgtagggtctttgcagatcttgtctgagcatgcttcttgctgtgtatgcacgtagttttctaaatctccctgtatgtgctgttgaatattctaatttcccaaagaaactcctttgcagctttttctcacagaacatagatggttttttggatatcttgaccatagtctttcgacccaggtgtttgcggttgttagttcaccttacacttttttcaagcattgcctactgcttacgatgagtgctctgtcactcctttaagtagccccagacaggctaccagagacttaaacaagaatttgtaagttctgctcagcttcctctagaaatggggatcagggtccaagacagaatgcagttgctgatttcaagactgctgcaacaccagggagcttgtgggggaagggcaagcagaaatgtcacaaagctttcttgccattttaaagttgcctgttcttgactcagcatttgcttcattgctataaactttttactgtttttcagagttctgataaaattggctatgcctgttcctgctttaaaaaatatatatatattttttagggattggggtctcactatactgaccaggctggtcttgaacttctggcctcaagccatcctctcatttcagcttcccaaagtgctgcaattacacgcgtgaaccaccacacccagcccctgcttgtttttcaatgtgcctactccaccatgttgctcaagtatgtatattttctaaactaccttgtagtgttgtgatgggaaataaatccctgagccttttgaataactcagagagatcaaaaacttagtttatcctattcgaaggattagaaaaatgatatatctttcactttttcagggataggctcctcattagaaggctcctatgtgccgatgctgtacaagacatttcatttctcttaatgtttacaacaagcttgttgccaaggctgatcttgaactcctggcctcaaacgatcctcccagctcagtctcacaaagtgttgggatgtctggccaactaatgactatcttaactcttgtgtttcaatgtttatgccttcttttatcttgactgattgtatgactatgtcttctagaacaatgttgaacagaaatggtgagagcagacatccttgctttaatatttcaccattatatatgatgttaggtatagatttttctcacagatgccttttatcagattgaggaatttatattcctactttgccgaaaggtttttgtagtatgagggggtgctgaattttgtcaaacactttttcggtaataattgagatgattggttctgcagtcatcgagatgtggattttctcctttattctgttcgtgagtgattacactggttgactaatgttaaaacaaccttactttccaggaataaaccctattatcttttttatacattgctggatttgatttgctaattattttaaggacttttatttctacattcatgatagatactgctggtattttctcatgatgtcttttgcaggatttgtatcatatatggcatttctgaggtatacctaagtatcatttattcaaggacctaagaaatggaaaaatcaattgaggtgatttttccatcatgaaaaaaatttctttaaagtcatctgtctgattctgtaaaaatttcacattctttatgtgaacaaaaagctgaaagaaattcagggaaagaattaagatgtgatatcaattgccaacccaatgttttgttcttgctagttgtgttccccctccttattccatccatttcatagtaataagaaaaaaaagaattttacattgagatttttaggtaaatttttgaattacagtatatgataaaaaccttaacgttcaaactccaggtataatgaaatttaattgaaaattactatagcagtttaagtcaatttgtagttttgaaagcagttttaatattttatcttccacaaaaaggtaggaaagtttctgtgctgaacttaaatatataaaggaacacgtccaacatatttagttaaaaatccaaaagtcagaggataatttccaaatgtgtacttaaatagaaaaaaattacaaatttcatgtgcaataaagtgtctgccacttacgtaaaaaaaaaaaaaacccaaaactatgtacacatagaaacacgtaacatttttgtaaatagagaaaaggtctaaaaggataacattaaaatgaaaacagcagttatctctggggacagcggttgtgtggaaatgctaactgcttttcaacaatagtttgcattttctagatgagattctatccttgtataattttgttactaatataaacatcaaaaaattcttcataccagtgaatcacaagtcctcactgcaacagacataacaaatccaactcctaaaataaattatatgtagttttgaaggtagaggtgacataaaagtaggctgtatattcaaatcctacaatatattcaattttttccaattatcttttgaacaacaatttgcaaaatatatttacagtttcccttaagttatttaataagtagacttagaaaaattactagtaaactaacatttttggaaaattttcttaatttcttttgattaaattatcttgcctctgttttattagacaaatattttatcagaaaatgaatcacatgttgtgagtatttaaaatatctgtttccttcttagtcctaccaccaatgacaaaaaaacaaaatagtaacttgctaataagtaatgacttaatgcttcaaaaaacatcaacaaatttaaaagaaaggccaaacatggttgctcaagcctgtaatcccagcactttgggaggtcaaggtgggtagactgcttgagctcaagagttcgagaccagcctgggcaatgtcacgaaaccccatctctaca

SEQ ID NO: 326919 - DNA, 4256 bp, Homo sapiens
  misc_feature (4067)..(4070): n is a, c, g, or t
  misc_feature (4081)..(4081): n is a, c, g, or t
cagagtatctttttctatgtgttccatgtatttgtgtctttggagctatagtctcttgtagacagcatatcactatctgtttgttttgttttgttttttctgtccattctgccaatttctgccttttgattggaaaatttaatccatttgcatttaaagtaattaaggaaggactttcttctaccatttaacacttcttctatatgtcatatacttttttggcccctcatttcctctttatggccttcttttctgtttttttgtagtgaactagtctgattctctttccactcccctttgtgtatatttgttagatgttttatttgtggttgctatggggattatagttaacatcctacacttaaaacaatctaatttaaactgataccaatttaccttcaatagcatacaaaatctctactcctgtaaagctctgcccctgccccccttatgttattgatggcacaaattgcctaataaataatttatagttatttgtatgagtttgtcttttaaatcatttaggaaataaaaagtggagttagaaaacagtatgatagtaatactgacttttatatttgtcaatatatttatcttattttggatccttatttcattatatagatttgagttactgtctagtgcccttccatttcggcccaaaggattcccttatgcatttcttgcagggcaagtctaattgtaataaactccctcagcttttgttttatctgagaatgtcttgatttctcccttatttttgatggataattttgccagatacatgaatttttggtaacagtatttttctttcagcactttaaatatgtcatcccactaccttctgacttcatggtttctcatgagatattagatgttataaaatttgaggattcctcattcttgatgagtcagttctgtcttattgcttttcggatttgctcagcttttgtcttttgacagtttgattataacgcggctcagtgtgggtctctgagtttatcccacttagagtttgttgagtttcttggagtcatagatttatgtcttttatcaaattttggacatatttggctattatttcttcaatttttttcactgcttctttcttttccttctgaaatattcttaatgtatatgttggtctgtttgatgctgtctcaccagtttcttaggctgtgttctctttgttcctcagacttgattattgcagttgcccttctttttatttttttcaagtttgttgattcttctccctgttcagatcaactgttgaactcctctagtgaatttatttcagttactgtacttttcagctccaagatttatctttggttcctttttataacgtctgtgtctttattgatattctcattttgttcatatgtctctttcttcctttagttctttgtccatgttttcctttagctctttgggcttatttaagacaattgtttaaagtctttgcatagtaagtccaatgtctgtgtttcttcagggatggttttcattattttgttttcaatgagccatactttcctgtgtctttgtatgctgtctttttgttgttgaaaactgtatgtttgaacatcataacgtggtggccctgaaaatcagatattccccccttcctgagagttagttttatttttattattgaagattgtagcagtctattgctacatgtgcagtcatttccaaactatttttgcaaagactgtattccttctgtgtgtcatcactgaagtctctgttccttagtttgtgtttaatagtttgacatagatttccttgaaaggagttaaaactagcagaaaaatctctctcccagtctttccagtctttgtagattggttctgtgctgggcttttccattaatacttagccaggcttgtactgagcctaacaatcaggcccaaaagcgtagggtctttgcagatcttgtctgagcatgcttcttgctgtgtatgcacgtagttttctaaatctccctgtatgtgctgttgaatattctaatttcccaaagaaactcctttgcagctttttctcacagaacatagatggttttttggatatcttgaccatagtctttcgacccaggtgtttgcggttgttagttcaccttacacttttttcaagcattgcctactgcttacgatgagtgctctgtcactcctttaagtagccccagacaggctaccagagacttaaacaagaatttgtaagttctgctcagcttcctctagaaatggggatcagggtccaagacagaatgcagttgctgatttcaagactgctgcaacaccagggagcttgtgggggaagggcaagcagaaatgtcacaaagctttcttgccattttaaagttgcctgttcttgactcagcatttgcttcattgctataaactttttactgtttttcagagttctgataaaattggctatgcctgttcctgctttaaaaaatatatatatattttttagggattggggtctcactatactgaccaggctggtcttgaacttctggcctcaagccatcctctcatttcagcttcccaaagtgctgcaattacacgcgtgaaccaccacacccagcccctgcttgtttttcaatgtgcctactccaccatgttgctcaagtatgtatattttctaaactaccttgtagtgttgtgatgggaaataaatccctgagccttttgaataactcagagagatcaaaaacttagtttatcctattcgaaggattagaaaaatgatatatctttcactttttcagggataggctcctcattagaaggctcctatgtgccgatgctgtacaagacatttcatttctcttaatgtttacaacaagcttgttgccaaggctgatcttgaactcctggcctcaaacgatcctcccagctcagtctcacaaagtgttgggatgtctggccaactaatgactatcttaactcttgtgtttcaatgtttatgccttcttttatcttgactgattgtatgactatgtcttctagaacaatgttgaacagaaatggtgagagcagacatccttgctttaatatttcaccattatatatgatgttaggtatagatttttctcacagatgccttttatcagattgaggaatttatattcctactttgccgaaaggtttttgtagtatgagggggtgctgaattttgtcaaacactttttcggtaataattgagatgattggttctgcagtcatcgagatgtggattttctcctttattctgttcgtgagtgattacactggttgactaatgttaaaacaaccttactttccaggaataaaccctattatcttttttatacattgctggatttgatttgctaattattttaaggacttttatttctacattcatgatagatactgctggtattttctcatgatgtcttttgcaggatttgtatcatatatggcatttctgaggtatacctaagtatcatttattcaaggacctaagaaatggaaaaatcaattgaggtgatttttccatcatgaaaaaaatttctttaaagtcatctgtctgattctgtaaaaatttcacattctttatgtgaacaaaaagctgaaagaaattcagggaaagaattaagatgtgatatcaattgccaacccaatgttttgttcttgctagttgtgttccccctccttattccatccatttcatagtaataagaaaaaaaagaattttacattgagatttttaggtaaatttttgaattacagtatatgataaaaaccttaacgttcaaactccaggtataatgaaatttaattgaaaattactatagcagtttaagtcaatttgtagttttgaaagcagttttaatattttatcttccacaaaaaggtaggaaagtttctgtgctgaacttaaatatataaaggaacacgtccaacatatttagttaaaaatccaaaagtcagaggataatttccaaatgtgtacttaaatagaaaaaaattacaaatttcatgtgcaataaagtgtctgccacttacgtaaaaaaaaaaaaaacccaaatnnnnttccccttagnaaccccctatacctctcggggactcaggagaaagggtctacaggctaccctaacctggacaccgcggtactcccggggaccgcggtgcggtgcaaatcgcacgggtctcaccacggtgggctctccacaggaccaccggcaaccggccaataacccaaatctcaccggacaagcg

SEQ ID NO: 326920 - DNA, 6272 bp, Homo sapiens
cttccatgtgtgaaagctacttggcatgaatgcctgggccgtaccaagtgtcaccgcagcaagagggggagtcagaagaaaaacagatcagaccaagcagacaataggcccctaaagtgttccccctaagttgctttgatgttgtcctggtgtcttgataccaggaggccagggattgcgggaaaagggtcttttttgtcttcattcactttcccccctcagtttctgaaatgattctccagaatttctcctcataaaaaaggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagccggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttctta

SEQ ID NO: 326921 - DNA, 6152 bp, Homo sapiens
cgccgccgctgccgccgccggggggagacgctgcgccgccgctgccgctggccccggccccgcggggctgagagccgccccggacccaagcctctttccctgctccgcacctcctctcccctcccccactcctgcctccggggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagccggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttctta

SEQ ID NO: 326922 - DNA, 5930 bp, Homo sapiens
cgccgccgctgccgccgccggggggagacgctgcgccgccgctgccgctggccccggccccgcggggctgagagccgccccggacccaagcctctttccctgctccgcacctcctctcccctcccccactcctgcctccggggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcaggaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagccggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttctta

SEQ ID NO: 326923 - DNA, 5698 bp, Homo sapiens
cgccgccgctgccgccgccggggggagacgctgcgccgccgctgccgctggccccggccccgcggggctgagagccgccccggacccaagcctctttccctgctccgcacctcctctcccctcccccactcctgcctccggggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagccggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttctta

SEQ ID NO: 326924 - DNA, 4058 bp, Homo sapiens
cgccgccgctgccgccgccggggggagacgctgcgccgccgctgccgctggccccggccccgcggggctgagagccgccccggacccaagcctctttccctgctccgcacctcctctcccctcccccactcctgcctccggggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagccggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggtaagaaatcagaaaggcaggttgtggagtgagtgctagaccaaagagaaacctcttgaagcgttttctcaatggctatacacctgaataggtggaagttcaacaagtagaaaaaatcttccatctaaggtagtttcagtagaatgaaagtgtcttgactagaggaagataatttcttattagcttgattccttatttgtttgtaagaaagcaggtttctttatagttctgatgcttctgtgtacctggatggttttgagggtttgttgtttttgt

SEQ ID NO: 326925 - DNA, 331 bp, Homo sapiens
cagccatgctgggaaatgtagagtcaggtcagtatgcttgcatcctcacagttgcacctagtagctggagactgctagacctgatagttactttaagaaaactggtgtcttgagtacacagacagaggaggcagtctttgttgaaatggccatatttgtggcaaggtgcataatcagtgcttccatggggttatgcagaagtgtccaatctcagcaaaaaatacgtatgtcagagagactgttgaagaggggaaatggggaatatgtgttgggttcacagaataatttacattcgcacaatgaacaaatgcaataaaatgtcttaacagtg

SEQ ID NO: 326926 - DNA, 447 bp, Homo sapiens
ttggaaagttcttccgtgtcccgatgtagaagaaatagcaaattggacatattgaaaggtaaagaatatcctgataagtcagttccttttgtgattcaatctgaatatgttggatttttgtttctgtttctatagggcctcttgtaagttaaaactacgtttattcattattctaagaattctcaaggcaaaagtcatcaaactaaatgcaagtcaaaaatataagagcagttacacctttctgtgagcagggacttgtacaataactcatttcatagggccaaggataaaggcaggtggtgagaagttaaacaggtatttatcataccatcgttgtgtgtgaatgcaaggtaaaggtagcaatacacaagccccaagctcattataatacatggatcaaacagcattgattgagtttcttccaggtatcaggtgctgagaggagga

SEQ ID NO: 326927 - DNA, 5615 bp, Homo sapiens
ggctgaggtgaatcatggggtggttattttagtcctaagggtctccttgacccccaatagaaactgcctctctctaatttgtgctgaccagctgtatctggtgtctgatcttcctttgttatttgtttcttttagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagccggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttctta

SEQ ID NO: 326928 - DNA, 6550 bp, Homo sapiens
cgccgccgctgccgccgccggggggagacgctgcgccgccgctgccgctggccccggccccgcggggctgagagccgccccggacccaagcctctttccctgctccgcacctcctctcccctcccccactcctgcctccggggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagccggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttcttacaaaattgaactgccttttttgttcatttggattcctgattgtttagtattgggcataccggttgccatgtgacccagaagcgtagactctttgtattggagttgatcagtaaggtgatggttagggaaaccacataaaagtaccttctcaaagcatattccatgctgttaaggaataactactcatgtaggtttattctgtactgttcctatctcagtcatgaaatcctagttataagcagaagagcaaccctggtcccattgctgaactttacctttagggcaattaatggtctttattaggaatgtttgtgagagccagtttagtggtatgaagtaattaagaaggccaaaggttgtatgtttagttatttgaataagctatgagatgtcccttg

SEQ ID NO: 326929 - DNA, 195 bp, Homo sapiens
agttctctaaagaggaagatagcagaaataggttcacaaactttattttcaaaaatcaataaatatgtagtaggcatccactatatgctctgtataatcttatcgaaatgtctaacagaaacttgatgataaaaccaaatctgccatttgcttgctaccgctctgtttcagaaattcactcacacaccacacaca

SEQ ID NO: 326930 - DNA, 924 bp, Homo sapiens
atttgattggtaagctgagtcattacttggaggactacgaatgaactacaaatacttgatgagaagccatcactttgggcttctccgaatgagagaattcttataactgggcatgtcctttacaaggacgtagaagctgagactgtcacaaggatattggtttctatttgagacatggtttctaaggacacacagaaccatgcaaagaatttaaactacatccatttgaaacacattctcctttggaagaagtgaaaagcagagtggaggtgaggaagtagaaaggacctcactgtgatctccttctttagctcaaggttgctgcaagctggagctgagctgtcagtggaacgggtcctggaaatcattaagcaaggcgtcgttgcgctgcccaaagacagactgaagatcctgtgctccaacgctgtcagccgctggccgatcgtcaggtggacagagtccttgcatgccaggcctttgtgtatgcagcttctgggttctcacagtttcatggcttgtctgtcagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgcta

SEQ ID NO: 326931 - DNA, 464 bp, Homo sapiens
catccaatcctcgatccataatgcggtccgcggggcccccccagggcacactcaggagtacaccgcaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgcta

SEQ ID NO: 326932 - DNA, 666 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattaggctgtctaggccggacacagtggctcacgcctataatcccagcattttgagaggctgatgcgggtggatcacgaagtcaggagttcaagacca

SEQ ID NO: 326933 - DNA, 390 bp, Homo sapiens
atgaatgttgtaccttggtatcccggacaaagctgccattatgaagtggctacactatctggggtgtataccctagggtttgttgttgcctgccgagaaagaattaggacacggacatgtgggtgggttaaggagtggaaagcttaatagacagaagaaaggagagaggagagcagctccttgagaaagagacgtgttcgaaaaaggaaggatgaaagtagtggctagcctcagctttaggggcaggcgatgaggagccagatcagtatttctatctcagattcagaagacccagctgtccatgtgcatcatcggggaagcatcttgctctcagaataagcagctcaatccagctcccaaattctgaccgtggcttcagtgcctttgtgg

SEQ ID NO: 326934 - DNA, 2638 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgcta

SEQ ID NO: 326935 - DNA, 4793 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaacatgcagttttatttcgaagccaaaaatctagagctttcccaagatcctgttgccttaggcacatcacacttcaacagtgcacactatccaacagtgcacactattcaacagtgcacactattcaaaagcgtagactatttttttgcatgttcaagatatttgttttggtcttatgtgtgtgtgagagagagagattcctttgacattaaggagcatcaatgagaaaagatgatgaggcaggaattaataaagaaatgaagtcgtgtgtgtttggttgcctgtcagagggcacacaatttcataaacaccatgcctggacaatttgatattaatatttaacacctctgcatcttttcttaaaaaagaatatgggccagatacagtggctcacatttgtaatcccagcactttggggagccaagttagcagaatcccttgagcacaggaatctgaaaccagcttgggcaacatagtgagatcccatctctacaaaaaacttaaaaattagccaggcatgatggcacattcctgtagtcctagctactcaggaggctaaggtaggaggattgcctgagcccaggagttcaaggctgcagtgagctaagaacgtgccagtacactccagcctgagccacaaagtgagaccctgtctcgcaaaaaaaaaaaaaagaaagaaaagaaaaagaaaatggctacttctcatgaagcccagattaacttttctgtgaatatggcctgtgaactgttgctggaattaaattggagtctagcacaaattaagttaatctactctgtattaatcattgggaaaaagaaaagcttcatttgaaaacagtctttttccttcacccacactaatagaaaaaggagagtaatttgttcatactgtattccacgtgggatgaaaagcatgttttgctctttgtttctgggccggtgtgatccgtgtgttggtgcctgagctggaggaaggagcttcttgcagggaaacagccactggggccacattgagggccagttgggaccttcctttccagtcacactctgtgtcctcacgggccccttcacagtctagataaggagcctagtttcattctcaaagaaaaagtatttggtcttcaacatagaaagcacaaaagcccagacgagactgagcacactgttcgaatccactgccagctcatctgtgtcagggctggcttctcctgtcctgtgtcccagggctgcaggcccgtgttatttgagtccatcaaatcttccgagggcctcggaggaaccattctcagtcaccccaagctctgtaaaaggtcaaaacactggcagcctctcagtgcaccactgtgtgggctccacacgggaaggcctggccaagctgtgctcttagaggctgtcgaggtagggcaggaagcttccctatcctcgtctggatggaatgaaacagaggttccctaaggccaagggactcgtggagcgcccatcccgggtggggtcccagaggtgagtgcagcttgcctcctgtccccaaggggcttgttctgtcaggcctcctccagtcactgctggagtggggactctgactcctgtgttcacctcagagcccatgtacaggctagaggtgaggcttggcaacaacttctactaatacttagctttgtggcagagccagtctgaaggaggagaagcgctctcagccagcagggggagtgatgattatcatttcaggtagcaaggatatgtatttactatgtggggaaataatttgcaactttaatttgtttccaaagcattttgattggcttccttttcctttaaaccaaaaaattgtttaaatgtttaagggtcatgtggaacagctgagcttctggcaggaccacagaactgtcctctgagtctgagggctgggcagtgccacaggacagtccctgggctgcaggactgtcagtgcttgttgtgtgaggaaatgaggcccttcaaaaacccagtcatcttgacagagggcacactcccaaggaaggcctgactggggaatcatacagcctctcctccaggcctctgggctcactgaggtgcccccagaacccatgaagtggagcccacaacctgaatggagccccaacctgtatagagcccgagggatcctctagatcga

SEQ ID NO: 326936 - DNA, 5073 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagccgctggccgatcgtcaggtggacagagtccttgcatgccaggcctttgtgtatgcagcttctgggttctcacagtttcatggcttgtctgtcagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaacatgcagttttatttcgaagccaaaaatctagagctttcccaagatcctgttgccttaggcacatcacacttcaacagtgcacactatccaacagtgcacactattcaacagtgcacactattcaaaagcgtagactatttttttgcatgttcaagatatttgttttggtcttatgtgtgtgtgagagagagagattcctttgacattaaggagcatcaatgagaaaagatgatgaggcaggaattaataaagaaatgaagtcgtgtgtgtttggttgcctgtcagagggcacacaatttcataaacaccatgcctggacaatttgatattaatatttaacacctctgcatcttttcttaaaaaagaatatgggccagatacagtggctcacatttgtaatcccagcactttggggagccaagttagcagaatcccttgagcacaggaatctgaaaccagcttgggcaacatagtgagatcccatctctacaaaaaacttaaaaattagccaggcatgatggcacattcctgtagtcctagctactcaggaggctaaggtaggaggattgcctgagcccaggagttcaaggctgcagtgagctaagaacgtgccagtacactccagcctgagccacaaagtgagaccctgtctcgcaaaaaaaaaaaaaagaaagaaaagaaaaagaaaatggctacttctcatgaagcccagattaacttttctgtgaatatggcctgtgaactgttgctggaattaaattggagtctagcacaaattaagttaatctactctgtattaatcattgggaaaaagaaaagcttcatttgaaaacagtctttttccttcacccacactaatagaaaaaggagagtaatttgttcatactgtattccacgtgggatgaaaagcatgttttgctctttgtttctgggccggtgtgatccgtgtgttggtgcctgagctggaggaaggagcttcttgcagggaaacagccactggggccacattgagggccagttgggaccttcctttccagtcacactctgtgtcctcacgggccccttcacagtctagataaggagcctagtttcattctcaaagaaaaagtatttggtcttcaacatagaaagcacaaaagcccagacgagactgagcacactgttcgaatccactgccagctcatctgtgtcagggctggcttctcctgtcctgtgtcccagggctgcaggcccgtgttatttgagtccatcaaatcttccgagggcctcggaggaaccattctcagtcaccccaagctctgtaaaaggtcaaaacactggcagcctctcagtgcaccactgtgtgggctccacacgggaaggcctggccaagctgtgctcttagaggctgtcgaggtagggcaggaagcttccctatcctcgtctggatggaatgaaacagaggttccctaaggccaagggactcgtggagcgcccatcccgggtggggtcccagaggtgagtgcagcttgcctcctgtccccaaggggcttgttctgtcaggcctcctccagtcactgctggagtggggactctgactcctgtgttcacctcagagcccatgtacaggctagaggtgaggcttggcaacaacttctactaatacttagctttgtggcagagccagtctgaaggaggagaagcgctctcagccagcagggggagtgatgattatcatttcaggtagcaaggatatgtatttactatgtggggaaataatttgcaactttaatttgtttccaaagcattttgattggcttccttttcctttaaaccaaaaaattgtttaaatgtttaagggtcatgtggaacagctgagcttctggcaggaccacagaactgtcctctgagtctgagggctgggcagtgccacaggacagtccctgggctgcaggactgtcagtgcttgttgtgtgaggaaatgaggcccttcaaaaacccagtcatcttgacagagggcacactcccaaggaaggcctgactggggaatcatacagcctctcctccaggcctctgggctcactgaggtgcccccagaaccctgattgccctcccctctttcccttttctcattcatcacacagtagaagcactcactagctaacagctcagctggggcagcagcctccatggaggcctgcaagtgatgctcccagtcctggttcccgctcaggagggaggccccaccacgtgcatcactgcctcagctctgcaaagtcaccagaggcttcttcctgatttttgtgaaagatttattatatggcaataaatctgaatgataaactttcaaaatac

SEQ ID NO: 326937 - DNA, 2859 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagacagagtttcactcttgttgcccaggctggagtgcaatggcatgatctcggctcaccacaacctctgcctcccgggattaagtgattctcctgcctcggcctccccagtggctgggattgcaggctggagtgcaatggtgccatctcagctcaccgcaatctctgcctcctgcattcaagtgattctcctgcctcagcctcccgagtagctgaaattacagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgcta

SEQ ID NO: 326938 - DNA, 2517 bp, Homo sapiens
atgaatgttgtaccttggtatcccggacaaagctgccattatgaagtggctacactatctggggtgtataccctagggtttgttgttgcctgccgagaaagaattaggacacggacatgtgggtgggttaaggagtggaaagcttaatagacagaagaaaggagagaggagagcagctccttgagaaagagacgtgttcgaaaaaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgcta

SEQ ID NO: 326939 - DNA, 2585 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatcgttatttggcacacacacgggcgcaggaccaatacaccaaccaagttaattacattgttcaaaaccctggctatttccaccacacacactacgacacccataataccaacactcagaactccatcatccacaactaactttaaccaactctcctacatactagccacaatctgatccccaatac

SEQ ID NO: 326940 - DNA, 3264 bp, Homo sapiens
atttgattggtaagctgagtcattacttggaggactacgaatgaactacaaatacttgatgagaagccatcactttgggcttctccgaatgagagaattcttataactgggcatgtcctttacaaggacgtagaagctgagactgtcacaaggatattggtttctatttgagacatggtttctaaggacacacagaaccatgcaaagaatttaaactacatccatttgaaacacattctcctttggaagaagtgaaaagcagagtggaggtgaggaagtagaaaggacctcactgtgatctccttctttagctcaaggttgctgcaagctggagctgagctgtcagtggaacgggtcctggaaatcattaagcaaggcgtcgttgcgctgcccaaagacagactgaagatcctgtgctccaacgctgtcagccgctggccgatcgtcaggtggacagagtccttgcatgccaggcctttgtgtatgcagcttctgggttctcacagtttcatggcttgtctgtcagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaacatgcagttttatttcgaagccaaaaatctagagctttcccaagatcctgttgccttaggcacatcacacttcaacagtgcacactatccaacagtgcacactattcaacagtgcacactattcaaaagcgtagactatttttttgcatgttcaagatatttgttttggtcttatgtgtgtgtgagagagagagattcctttgacattaaggagcatcaatgagaaaagatgatgaggcaggaattaataaagaaatgaagtcgtgtgtgtttggttgcctgtcagagggcacacaatttcataaacaccatgcctggacaatttgatattaatatttaacacctctgcatcttttcttaaaaaagaatatgggccagatacagtggctcacatttgtaatcccagcactttggggagccaagttagcagaatcccttgagcacaggaatctgaaaccagcttgggcaacatagtgagatcccatctctacaaaaaacttaaaaattagccaggcatgatggcacattcctgtagtcctagctactcaggaggctaaggtaggaggattgcctgagcccaggagttcaaggctgcagtgagctaagaacgtgccagtacactccagcctgagccacaaagtgagaccctgtctcgcaaaaaaaaaaaaaagaaagaaaagaaaaagaaaatggctacttctcatgaagcccagattaacttttctgtgaatatggcctgtgaactgttgctggaattaaattggagtctagcacaaattaagttaatctactctgtattaatcattgggaaaaagaaaagcttcatttgaaaacagtctttttccttcacccacactaatagaaaaaggagagtaatttgttcatactgtattccacgtgggatgaaaagcatgttttgctctttgtttctgggccggtgtgatccgtgtgttggtgcctgagctggaggaaggagcttcttgcagggaaacagccactggggccacattgagggccagttgggaccttcctttccagtcacactctgtgtcctcacgggccccttcacagtctagataaggagcctagtttcattctcaaagaaaaagtatttggtcttcaacatagaaagcacaaaagcccagacgagactgagcacactgttcgaatccactgccagctcatctgtgtcagggctggcttctcctgtcctgtgtcccagggctgcaggcccgtgttatttgagtccatcaaatcttccgagggcctcggaggaaccattctcagtcaccccaagctctgtaaaaggtcaaaacactggcagcctctcagtgcaccactgtgtgggctccacacgggaaggcctggccaagctgtgctcttagaggctgtcgaggtagggcaggaagcttccctatcctcgtctggatggaatgaaacagaggttccctaaggccaagggactcgtggagcgcccatcccgggtggggtcccagaggtgagtgcagcttgcctcctgtccccaaggggcttgttctgtcaggcctcctccagtcactgctggagtggggactctgactcctgtgttcacctcagagcccatgtacaggctagaggtgaggcttggcaacaacttctactaatacttagctttgtggcagagccagtctgaaggaggagaagcgctctcagccagcagggggagtgatgattatcatttcaggtagcaaggatatgtatttactatgtggggaaataatttgcaactttaatttgtttccaaagcattttgattggcttccttttcctttaaaccaaaaaattgtttaaatgtttaagggtcatgtggaacagctgagcttctggcaggaccacagaactgtcctctgagtctgagggctgggcagtgccacaggacagtccctgggctgcaggactgtcagtgcttgttgtgtgaggaaatgaggcccttcaaaaacccagtcatcttgacagagggcacactcccaaggaaggcctgactggggaatcatacagcctctcctccaggcctctgggctcactgaggtgcccccagaaccctgattgccctcccctctttcccttttctcattcatcacacagtagaagcactcactagctaacagctcagctggggcagcagcctccatggaggcctgcaagtgatgctcccagtcctggttcccgctcaggagggaggccccaccacgtgcatcactgcctcagctctgcaaagtcaccagaggcttcttcctgatttttgtgaaagatttattatatggcaataaatctgaatgataaactttcaaaatac

SEQ ID NO: 326941 - DNA, 2792 bp, Homo sapiens
aatgattattaaacacgactccaacgaaattttgaccgccacggcaacattgacaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaacatgcagttttatttcgaagccaaaaatctagagctttcccaagatcctgttgccttaggcacatcacacttcaacagtgcacactatccaacagtgcacactattcaacagtgcacactattcaaaagcgtagactatttttttgcatgttcaagatatttgttttggtcttatgtgtgtgtgagagagagagattcctttgacattaaggagcatcaatgagaaaagatgatgaggcaggaattaataaagaaatgaagtcgtgtgtgtttggttgcctgtcagagggcacacaatttcataaacaccatgcctggacaatttgatattaatatttaacacctctgcatcttttcttaaaaaagaatatgggccagatacagtggctcacatttgtaatcccagcactttggggagccaagttagcagaatcccttgagcacaggaatctgaaaccagcttgggcaacatagtgagatcccatctctacaaaaaacttaaaaattagccaggcatgatggcacattcctgtagtcctagctactcaggaggctaaggtaggaggattgcctgagcccaggagttcaaggctgcagtgagctaagaacgtgccagtacactccagcctgagccacaaagtgagaccctgtctcgcaaaaaaaaaaaaaagaaagaaaagaaaaagaaaatggctacttctcatgaagcccagattaacttttctgtgaatatggcctgtgaactgttgctggaattaaattggagtctagcacaaattaagttaatctactctgtattaatcattgggaaaaagaaaagcttcatttgaaaacagtctttttccttcacccacactaatagaaaaaggagagtaatttgttcatactgtattccacgtgggatgaaaagcatgttttgctctttgtttctgggccggtgtgatccgtgtgttggtgcctgagctggaggaaggagcttcttgcagggaaacagccactggggccacattgagggccagttgggaccttcctttccagtcacactctgtgtcctcacgggccccttcacagtctagataaggagcctagtttcattctcaaagaaaaagtatttggtcttcaacatagaaagcacaaaagcccagacgagactgagcacactgttcgaatccactgccagctcatctgtgtcagggctggcttctcctgtcctgtgtcccagggctgcaggcccgtgttatttgagtccatcaaatcttccgagggcctcggaggaaccattctcagtcaccccaagctctgtaaaaggtcaaaacactggcagcctctcagtgcaccactgtgtgggctccacacgggaaggcctggccaagctgtgctcttagaggctgtcgaggtagggcaggaagcttccctatcctcgtctggatggaatgaaacagaggttccctaaggccaagggactcgtggagcgcccatcccgggtggggtcccagaggtgagtgcagcttgcctcctgtccccaaggggcttgttctgtcaggcctcctccagtcactgctggagtggggactctgactcctgtgttcacctcagagcccatgtacaggctagaggtgaggcttggcaacaacttctactaatacttagctttgtggcagagccagtctgaaggaggagaagcgctctcagccagcagggggagtgatgattatcatttcaggtagcaaggatatgtatttactatgtggggaaataatttgcaactttaatttgtttccaaagcattttgattggcttccttttcctttaaaccaaaaaattgtttaaatgtttaagggtcatgtggaacagctgagcttctggcaggaccacagaactgtcctctgagtctgagggctgggcagtgccacaggacagtccctgggctgcaggactgtcagtgcttgttgtgtgaggaaatgaggcccttcaaaaacccagtcatcttgacagagggcacactcccaaggaaggcctgactggggaatcatacagcctctcctccaggcctctgggctcactgaggtgcccccagaaccctgattgccctcccctctttcccttttctcattcatcacacagtagaagcactcactagctaacagctcagctggggcagcagcctccatggaggcctgcaagtgatgctcccagtcctggttcccgctcaggagggaggccccaccacgtgcatcactgcctcagctctgcaaagtcaccagaggcttcttcctgatttttgtgaaagatttattatatggcaataaatctgaatgataaactttcaaaatac

SEQ ID NO: 326942 - DNA, 848 bp, Homo sapiens
ttttgtattttgagtagatcgcctcaggtgatctgcccgccttggcctcccaaagtgctgggattacaggcgtgagccacagcgcccggccttcaggatatttcttttatagcattttctaattgggcttaacaagccctactttaagaaattaaaccttatgattagctgtcttaatatagaggcttaattgaagctgaattatgattcagttgaagttgaattgagttattggggcccctgtccccttgcaggaaggatgaaagtagtggctagcctcagctttaggggcaggcgatgaggagccagatcagtatttctatctcagattcagaagacccagctgtccatgtgcatcatcggggaagcatcttgctctcagaataagcagctcaatccagctcccaaattctgaccgtggcttcagtgcctttgtggaatgagaagggacatgaggaagaaagtgagtcactaatacacattctcacctgacctgagccgcctttggtccctgaggccatgtagtttcctttcattgtgatggtaattttaaaatagtataatgtattatttatcttatcaccattttattattcaatgggagaacttttctgaacaaatcaagataaaacatgatctaaatctatgttaagtgtgatttaagggagacagtgattcatatttgtaactagttttcttcccttagtgactgagaacaaccaatactgacttttgaagagcctcgtggatactaattatttattcactcccttgttccttcaacatactgtttagggaattttttacatgctagtctagacagtgggcatagacagatgaatgagata

SEQ ID NO: 326943 - DNA, 432 bp, Homo sapiens
attttctcaggagccatttgatagctgaaatattttaaagccccagagctttcatgccctgtgaccagttggcaggggtgggtgggctccccgcacaccacagcaccacctgcaaactctcaccacttttgcttgtgcatggaactgtgggattataaaatcatcttattttcattgcagaaaaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgta

SEQ ID NO: 326944 - DNA, 399 bp, Homo sapiens
aaatgaagtcgtgtgtgtttggttgcctgtcagagggcacacaatttcataaacaccatgcctggacaatttgatattaatatttaacacctctgcatcttttcttaaaaaagaatatgggccagatacagtggctcacatttgtaatcccagcactttggggagccaagttagcagaatcccttgagcacaggaatctgaaaccagcttgggcaacatagtgagatcccatctctacaaaaaacttaaaaattagccaggcatgatggcacattcctgtagtcctagctactcaggaggctaaggtaggaggattgcctgagcccaggagttcaaggctgcagtgagctaagaacgtgccagtacactccagcctgagccacaaagtgagaccctgtc

SEQ ID NO: 326945 - DNA, 453 bp, Homo sapiens
  misc_feature (47)..(47): n is a, c, g, or t
cgtgtgagtgtgttagtgctatttttgttttcgcgacggcaccttangagaaccaaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgcta

SEQ ID NO: 326946 - DNA, 4978 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaacatgcagttttatttcgaagccaaaaatctagagctttcccaagatcctgttgccttaggcacatcacacttcaacagtgcacactatccaacagtgcacactattcaacagtgcacactattcaaaagcgtagactatttttttgcatgttcaagatatttgttttggtcttatgtgtgtgtgagagagagagattcctttgacattaaggagcatcaatgagaaaagatgatgaggcaggaattaataaagaaatgaagtcgtgtgtgtttggttgcctgtcagagggcacacaatttcataaacaccatgcctggacaatttgatattaatatttaacacctctgcatcttttcttaaaaaagaatatgggccagatacagtggctcacatttgtaatcccagcactttggggagccaagttagcagaatcccttgagcacaggaatctgaaaccagcttgggcaacatagtgagatcccatctctacaaaaaacttaaaaattagccaggcatgatggcacattcctgtagtcctagctactcaggaggctaaggtaggaggattgcctgagcccaggagttcaaggctgcagtgagctaagaacgtgccagtacactccagcctgagccacaaagtgagaccctgtctcgcaaaaaaaaaaaaaagaaagaaaagaaaaagaaaatggctacttctcatgaagcccagattaacttttctgtgaatatggcctgtgaactgttgctggaattaaattggagtctagcacaaattaagttaatctactctgtattaatcattgggaaaaagaaaagcttcatttgaaaacagtctttttccttcacccacactaatagaaaaaggagagtaatttgttcatactgtattccacgtgggatgaaaagcatgttttgctctttgtttctgggccggtgtgatccgtgtgttggtgcctgagctggaggaaggagcttcttgcagggaaacagccactggggccacattgagggccagttgggaccttcctttccagtcacactctgtgtcctcacgggccccttcacagtctagataaggagcctagtttcattctcaaagaaaaagtatttggtcttcaacatagaaagcacaaaagcccagacgagactgagcacactgttcgaatccactgccagctcatctgtgtcagggctggcttctcctgtcctgtgtcccagggctgcaggcccgtgttatttgagtccatcaaatcttccgagggcctcggaggaaccattctcagtcaccccaagctctgtaaaaggtcaaaacactggcagcctctcagtgcaccactgtgtgggctccacacgggaaggcctggccaagctgtgctcttagaggctgtcgaggtagggcaggaagcttccctatcctcgtctggatggaatgaaacagaggttccctaaggccaagggactcgtggagcgcccatcccgggtggggtcccagaggtgagtgcagcttgcctcctgtccccaaggggcttgttctgtcaggcctcctccagtcactgctggagtggggactctgactcctgtgttcacctcagagcccatgtacaggctagaggtgaggcttggcaacaacttctactaatacttagctttgtggcagagccagtctgaaggaggagaagcgctctcagccagcagggggagtgatgattatcatttcaggtagcaaggatatgtatttactatgtggggaaataatttgcaactttaatttgtttccaaagcattttgattggcttccttttcctttaaaccaaaaaattgtttaaatgtttaagggtcatgtggaacagctgagcttctggcaggaccacagaactgtcctctgagtctgagggctgggcagtgccacaggacagtccctgggctgcaggactgtcagtgcttgttgtgtgaggaaatgaggcccttcaaaaacccagtcatcttgacagagggcacactcccaaggaaggcctgactggggaatcatacagcctctcctccaggcctctgggctcactgaggtgcccccagaaccctgattgccctcccctctttcccttttctcattcatcacacagtagaagcactcactagctaacagctcagctggggcagcagcctccatggaggcctgcaagtgatgctcccagtcctggttcccgctcaggagggaggccccaccacgtgcatcactgcctcagctctgcaaagtcaccagaggcttcttcctgatttttgtgaaagatttattatatggcaataaatctgaatgataaactttcaaaatac

SEQ ID NO: 326947 - DNA, 2849 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgagtgtaaatgaagacatttattatgattcttttttaagtattaaagcagagaatgtttaataagccttggtaagaactataatagtaagagtttcttctttcaacattaactgtatttgcagtctattttactataatagttgtggtaatctgtgtgtgtgttgtatatacacacacatacatatttaatacaattgaagtcatacttcatacagttttttattctgacttttttactttacacttagaccatgagcatttttctgtggtattatcaattctttgaaagtctcacattttaatttctatctagcccatgtttgtgtcctaaaatatatataactattatcccatttttgctcatttatttccagtattttatatcaattcataatgaatgaaaagtttataaataagtcttatctcaaattttaaaattatatttttgatatggttttaaagctggaattttactagtttttactgtcaaaagatatctttattttcaagattcaacacaggttgccaaattgctttccagaaaaactgtagaatttatgcctgtgggccgggtgtggtggctgatgcctataatcccagctacttgagaggctgaggcaggagaatcgcttgaacccaggaaatagaggttgcagtgagccgagatcacaccattgtactctggcctgagcaacgagagtaaaactccgtctcacacac

SEQ ID NO: 326948 - DNA, 2415 bp, Homo sapiens
cgcgcgccgcgtgccacgtgaccacctggctggcgcgcgcgcctgggggtctggtccctagccgcgttctcggtcgcttccctcttctctcgccgcctcctggcgttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgcta

SEQ ID NO: 326949 - DNA, 2667 bp, Homo sapiens
cgcgcgccgcgtgccacgtgaccacctggctggcgcgcgcgcctgggggtctggtccctagccgcgttctcggtcgcttccctcttctctcgccgcctcctggcctccgcaccgacgcggcccgggctggagccgagccggggccgagctgcaggccggaccggagccggatctgtacccgctgagacgtggaaacatggaggcctgagccggtgtgcgccacctgggctgcggcggcgacagcgacttctcctgacccctctgccaccctcccatccgtccgcgggtccgtggagctggagcagatcccccagccggctgagacaggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcagtagtgagttgaaactcttggaggaagcaaccatttcagtctgcaggtcattagttgaaaacaatcctcgaacaggaaatcttggtgcactaattaaggtcttcctttctagaaccaaagaactaaaactttcagcagaatgtcagaaccacatcttcatttggcagacacacaatgctttgtttattatttgctgtttgctgaaagtgttcatctgtcagatgtcagaggaggaattacaacttcattttacttatgaagaaaaatctcctggcaattacagttctgactcagaagatcttttggaagaattgctgtgctgtttgatgcagttgatcactgatattccactcttagatattacatatgaaatatcagtagaagctatatcaacaatggttgttttcctttcctgccaactcttccacaaagaagttttgcgacagagcatcagccacaagtatttgatgcgaggtccatgtcttccatacaccagcaaacttgtgaagaccttattatataactttatcagacaagaaaagccacctcctccaggggcccatgttttccctcagcagtcggatgggggaggactgctttatggacttgcatcaggagtagcaacaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaagatagcagtcctttcccctcatcaattccacatgccttccagatcaactttaatagtttgtacacagctctttgtgaacagcagacatctgatcaagcaactctcctcttgtataccttgctccatcaaaatagtaatattagaacatacatgttggctcgcacagatatggaaaatcttgttttaccaattcttgagattctgtatcatgttgaagaaaggaattcacaccatgtgtatatggcccttataatattgttgatccttacggaagatgatggcttcaacagatccattcatgaagtgatactaaaaaatattacttggtattcagaacgagttttaactgaaatctccttggggagtctcctgatcctggtggtaataagaaccattcaatacaacatgactaggacacgagacaagtaccttcacacaaattgtttggcagctttagcaaatatgtcggcacagtttcgttctctccatcagtatgctgcccagaggatcatcagtttattttctttgctgtctaaaaaacacaacaaagttctggaacaagccacacagtccttgagaggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctcaaggttgctgcaagctggagctgagctgtcagtggaacgggtcctggaaatcattaagcaaggcgtcgttgcgctgcccaaagacagactgaagaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctaaaaaaaaaaaatcggtctcgatggcctta

SEQ ID NO: 326950 - DNA, 2811 bp, Homo sapiens
ctttttattatatttttatattattacaggccccaccgaaaatgttgccgtgcacgttcaggagtattccagcaaatttccagaattgaaattcaaatatgtggaagaggagcagcccgaggagttttttatcccctatgtctggtctcttgtctacaactcagcagtcggcctgtactggaatccacaggacatccagctgttcaccatggattccgactgagggcaggatgctctcccacccggacccctccagccaagcagcccttcaagttcttttatttctgggtaacagaagtagacagacaggttacttggtgtatcttctgttaaagaggattgcacgagtgtgttttcctcacacactttgatttggagaattggtgctagttggcaatagataactcagcgtagatagtattgcaaaaaggggaggaaatacacaacaataataaatgtaaaaacctgctattcaacatgcagttttatttcgaagccaaaaatctagagctttcccaagatcctgttgccttaggcacatcacacttcaacagtgcacactatccaacagtgcacactattcaacagtgcacactattcaaaagcgtagactatttttttgcatgttcaagatatttgttttggtcttatgtgtgtgtgagagagagagattcctttgacattaaggagcatcaatgagaaaagatgatgaggcaggaattaataaagaaatgaagtcgtgtgtgtttggttgcctgtcagagggcacacaatttcataaacaccatgcctggacaatttgatattaatatttaacacctctgcatcttttcttaaaaaagaatatgggccagatacagtggctcacatttgtaatcccagcactttggggagccaagttagcagaatcccttgagcacaggaatctgaaaccagcttgggcaacatagtgagatcccatctctacaaaaaacttaaaaattagccaggcatgatggcacattcctgtagtcctagctactcaggaggctaaggtaggaggattgcctgagcccaggagttcaaggctgcagtgagctaagaacgtgccagtacactccagcctgagccacaaagtgagaccctgtctcgcaaaaaaaaaaaaaagaaagaaaagaaaaagaaaatggctacttctcatgaagcccagattaacttttctgtgaatatggcctgtgaactgttgctggaattaaattggagtctagcacaaattaagttaatctactctgtattaatcattgggaaaaagaaaagcttcatttgaaaacagtctttttccttcacccacactaatagaaaaaggagagtaatttgttcatactgtattccacgtgggatgaaaagcatgttttgctctttgtttctgggccggtgtgatccgtgtgttggtgcctgagctggaggaaggagcttcttgcagggaaacagccactggggccacattgagggccagttgggaccttcctttccagtcacactctgtgtcctcacgggccccttcacagtctagataaggagcctagtttcattctcaaagaaaaagtatttggtcttcaacatagaaagcacaaaagcccagacgagactgagcacactgttcgaatccactgccagctcatctgtgtcagggctggcttctcctgtcctgtgtcccagggctgcaggcccgtgttatttgagtccatcaaatcttccgagggcctcggaggaaccattctcagtcaccccaagctctgtaaaaggtcaaaacactggcagcctctcagtgcaccactgtgtgggctccacacgggaaggcctggccaagctgtgctcttagaggctgtcgaggtagggcaggaagcttccctatcctcgtctggatggaatgaaacagaggttccctaaggccaagggactcgtggagcgcccatcccgggtggggtcccagaggtgagtgcagcttgcctcctgtccccaaggggcttgttctgtcaggcctcctccagtcactgctggagtggggactctgactcctgtgttcacctcagagcccatgtacaggctagaggtgaggcttggcaacaacttctactaatacttagctttgtggcagagccagtctgaaggaggagaagcgctctcagccagcagggggagtgatgattatcatttcaggtagcaaggatatgtatttactatgtggggaaataatttgcaactttaatttgtttccaaagcattttgattggcttccttttcctttaaaccaaaaaattgtttaaatgtttaagggtcatgtggaacagctgagcttctggcaggaccacagaactgtcctctgagtctgagggctgggcagtgccacaggacagtccctgggctgcaggactgtcagtgcttgttgtgtgaggaaatgaggcccttcaaaaacccagtcatcttgacagagggcacactcccaaggaaggcctgactggggaatcatacagcctctcctccaggcctctgggctcactgaggtgcccccagaaccctgattgccctcccctctttcccttttctcattcatcacacagtagaagcactcactagctaacagctcagctggggcagcagcctccatggaggcctgcaagtgatgctcccagtcctggttcccgctcaggagggaggccccaccacgtgcatcactgcctcagctctgcaaagtcaccagaggcttcttcctgatttttgtgaaagatttattatatggcaataaatctgaatgataaactttcaaaatac

SEQ ID NO: 326951 - DNA, 3950 bp, Homo sapiens
ggaagttctgccttgtctccgccgcgggtcaggggtgagagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctcttatcccggaagctaaacagtggagataatctgatagtggaggaagcagtgcaggagctgaactctttcctcgcacaggagaatatgaggctacaggaattgacagatcttcttcaggaaaagcatcgcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaagactttgaggaggtcactacacaaaatgaaaagctgaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgagcgagatgaggttagtcttcataagaagctgaggactgaagtaattcagctagaagatacattggcccaggtccgcaaggagtatgaaatgctgaggatagaatttgagcagacccttgctgccaatgaacaagcaggccctataaacagggagatgcgccacctcatcagtagcctccagaatcacaatcaccagctgaaaggggaggtcctgagatataagcggaaattgagagaagcccagtctgacctgaacaagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggttgatgcccagctacaggtagtaaggaaactggaagagaaggagcatctgttacagagcaacattggcacaggggagaaagagctgggtcttaggacccaagccttagagatgaataaacgcaaggcaatggaggcagcccagcttgcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacaaagaaaccagacaatgtacccaagtgtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaagccttgggtttcagaatgaattagaaacaaataactcttactgtcttccctcccagctttgtttattttgtgcttttagacttttcagtgttttctttttccagcccactgtataaacttggattgtccattcctcctgaagaaatcaagttggtatttttgatgtggaaaagggaacaaaagtggaaacatggctacttttggggagtgatattttaaaaaataagttgtctatgggcacaaagttttcttcatttgtgtagcaaacttcttgtgaatgtggattacaaaatggtataattgtgctactctcccctgggtggtttgcagccctaatgaaattatgtctaggatgattcagtctatttcccatttactagcagagtaacttgttaagatcagctggctttcttgttaaagttatttaagttttgaatgctctactacttcaagtctttaaatttcttgagactagaataattttaaataatatgaccctttgtcttctaatgaaataaagattgaagaggttgagtcaggactgagctggtgaagaaatcttgtgggtattctggaaatttgatacggagagaacttggtgagctatgaattactctcagtctcctttttacagggttgttgtgatccctcttttccagaaaattctgtggaatgtttctgtaggactttgttctccacaagcttgaattaaagcaggattcagtttgcaaaaaaaaaaa

SEQ ID NO: 326952 - DNA, 2275 bp, Homo sapiens
tctatttctgaatcccacagaacacatctgccatcactatttccacctctggccaccccaccaatagcagcaataatacttttgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggttgatgcccagctacaggtagtaaggaaactggaagagaaggagcatctgttacagagcaacattggcacaggggagaaagagctgggtcttaggacccaagccttagagatgaataaacgcaaggcaatggaggcagcccagcttgcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacaaagaaaccagacaatgtacccaagtgtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaagccttgggtttcagaatgaattagaaacaaataactcttactgtcttccctcccagctttgtttattttgtgcttttagacttttcagtgttttctttttccagcccactgtataaacttggattgtccattcctcctgaagaaatcaagttggtatttttgatgtggaaaagggaacaaaagtggaaacatggctacttttggggagtgatattttaaaaaataagttgtctatgggcacaaagttttcttcatttgtgtagcaaacttcttgtgaatgtggattacaaaatggtataattgtgctactctcccctgggtggtttgcagccctaatgaaattatgtctaggatgattcagtctatttcccatttactagcagagtaacttgttaagatcagctggctttcttgttaaagttatttaagttttgaatgctctactacttcaagtctttaaatttcttgagactagaataattttaaataatatgaccctttgtcttctaatgaaataaagattgaagaggttgagtcaggactgagctggtgaagaaatcttgtgggtattctggaaatttgatacggagagaacttggtgagctatgaattactctcagtctcctttttacagggttgttgtgatccctcttttccagaaaattctgtggaatgtttctgtaggactttgttctccacaagcttgaattaaagcaggattcagtttgcaaaaaaaaaaa

SEQ ID NO: 326953 - DNA, 2607 bp, Homo sapiens
ggaagttctgccttgtctccgccgcgggtcaggggtgagagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctcttatcccggaagctaaacagtggagataatctgatagtggaggaagcagtgcaggagctgaactctttcctcgcacaggagaatatgaggctacaggaattgacagatcttcttcaggaaaagcatcgcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaagactttgaggaggtcactacacaaaatgaaaagctgaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgagcgagatgaggttagtcttcataagaagctgaggactgaagtaattcagctagaagatacattggcccaggtccgcaaggagtatgaaatgctgaggatagaatttgagcagacccttgctgccaatgaacaagcaggccctataaacagggagatgcgccacctcatcagtagcctccagaatcacaatcaccagctgaaaggggaggtcctgagatataagcggaaattgagagaagcccagtctgacctgaacaagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagcgttacggtagtggtgttatcggtgcccggtgtatcagtaacggtggtgttaaccggggtagtacctggaaccagattttcaaagtgctccccgccggtcacgcctttgatggcggtagtgacggtctggtcgcctttgtacacgtcatccggcgccatgg

SEQ ID NO: 326954 - DNA, 3916 bp, Homo sapiens
ggaagttctgccttgtctccgccgcgggtcaggggtgagagctggaatctctgcacgggccttggaaaacgactgtcttcttctgccaaaatgtcaggaattggaaataaaagagcagctggagaactgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctcttatcccggaagctaaacagtggagataatctgatagtggaggaagcagtgcaggagctgaactctttcctcgcacaggagaatatgaggctacaggaattgacagatcttcttcaggaaaagcatcgcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaagactttgaggaggtcactacacaaaatgaaaagctgaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgagcgagatgaggttagtcttcataagaagctgaggactgaagtaattcagctagaagatacattggcccaggtccgcaaggagtatgaaatgctgaggatagaatttgagcagacccttgctgccaatgaacaagcaggccctataaacagggagatgcgccacctcatcagtagcctccagaatcacaatcaccagctgaaaggggaggtcctgagatataagcggaaattgagagaagcccagtctgacctgaacaagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggttgatgcccagctacaggtagtaaggaaactggaagagaaggagcatctgttacagagcaacattggcacaggggagaaagagctgggtcttaggacccaagccttagagatgaataaacgcaaggcaatggaggcagcccagcttgcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacaaagaaaccagacaatgtacccaagtgtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaagccttgggtttcagaatgaattagaaacaaataactcttactgtcttccctcccagctttgtttattttgtgcttttagacttttcagtgttttctttttccagcccactgtataaacttggattgtccattcctcctgaagaaatcaagttggtatttttgatgtggaaaagggaacaaaagtggaaacatggctacttttggggagtgatattttaaaaaataagttgtctatgggcacaaagttttcttcatttgtgtagcaaacttcttgtgaatgtggattacaaaatggtataattgtgctactctcccctgggtggtttgcagccctaatgaaattatgtctaggatgattcagtctatttcccatttactagcagagtaacttgttaagatcagctggctttcttgttaaagttatttaagttttgaatgctctactacttcaagtctttaaatttcttgagactagaataattttaaataatatgaccctttgtcttctaatgaaataaagattgaagaggttgagtcaggactgagctggtgaagaaatcttgtgggtattctggaaatttgatacggagagaacttggtgagctatgaattactctcagtctcctttttacagggttgttgtgatccctcttttccagaaaattctgtggaatgtttctgtaggactttgttctccacaagcttgaattaaagcaggattcagtttgcaaaaaaaaaaa

SEQ ID NO: 326955 - DNA, 2503 bp, Homo sapiens
cgaccagcctgtggcgtggttggggctccggaagggcgcgcgcgagcgcttttttgggaggacaccacaggtggacgcctcagctgatcgtcctccctcccggggaccctgccccgagtcgccgagtagccgcagagtcgcctccgtcgccccgccgcccctgtgtttcggacatggccgcacgccttctccgagggtccctacgcgtcctgggcggccaccgtgcgccgcgccagctgcccgccgcgcgatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagaatgggagaaagctggagaagtaagtagggaggtttgggaaaaagctggaaaacaaggactgcttggtgtcaatattgcagagcatcttggtggaattggaggggatctgtactccgcagctattgtctgggaggagcaagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaagtgacttacagggaataaaaacaaatgctaaaaaggatggaagtgactggattctcaatggaagcaaggtgttcatcagtaatgggtcattaagtgatgttgtgattgtagttgcggtcacaaatcatgaagctccctcccctgcccatggtattagcctttttctggtggaaaatggaatgaaaggatttatcaagggacgaaagctacataaaatgggattaaaagcccaggataccgcagaactattctttgaagatatacggttgccagctagtgccctacttggagaagagaataaaggcttctattacatcatgaaagagcttccacaggaaaggctgttaattgctgatgtggcaatttcagctagtgaattcatgtttgaagaaaccaggaactatgttaaacaaagaaaagcttttggcaaaacagttgctcacctacagacagtgcaacataaattagcagaattaaaaacacatatatgtgtaacccgagcatttgtggacaactgtctccagctgcatgaagcgaaacgtttggactccgccactgcttgcatggcgaaatattgggcatctgagttacaaaatagtgtagcttacgactgtgtacagctccatggaggttggggatacatgtgggagtacccaattgcaaaagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggaaataaaatataaatataagattaacacagtggaaggacaaatctttgaagccaaaattctagttttccaatataaggtttaacttacagttttttatgtagccaaaggtaaacggttttctgaatcttgcctaggtgtttcatttatctctaaaattctaaaaagcataaatcattcaaatcttcaaaccaaggcagaaataattttatgtcgctatagtataaaaacattaataagatagcacattgacttttaaagggaaaagtaaatataacttagcatgtaaactcatttcggctaccatttgctccaaattccctagaacagtggtttttaccactgtactccaaccccgtttttaagcaatggaactctttcttcaaacaaaagcttatgcagaacatctctgtgaaacgctgctgagtgagaactgctttcattgaagctggaagccatcataccttactgccttgaaacccctaggactcagctaagtatttgcctaaccctgaccagggaatgccttggttctgtcaattgctgacatctgagaacacagaataatccatcatttttaatttcaagatattggtacattttataggtatcaaagcaatggcttttcttttgcaacagttaatgtatttattaacttaataattactttatgtcttctataaaccaggctgttaatacaatgatgacaaacaaaactggcaagatcactaaaaaataagtgaataaacaaataagtagtaaaataaggtaagaagtaaatatgtaaaagagataatttcaagcataagtgcaatgtaaataataaagtaagcatttaaaattcaaaagtgaggaaatgacatttgatttaagacttaaaagtaattacaaaaaataaaccattaatttaaagt

SEQ ID NO: 326956 - DNA, 813 bp, Homo sapiens
gaactctggtagaccactgttattgtgttggaaccagaaattttaaaattagtaaaaacaaaaagagaaaacactcaggaatgtcataggtttgtgatgagataggccactaccaaacaatttgataggaccttaatacattgttgttataatagtcgttttttattgctattttatgctctaatttttcttcttttttcattctaagagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaagtgacttacagggaataaaaacaaatgctaaaaaggatggaagtgactggattctcaatggaagcaaggtgtgtaaaagaggacttctatagcccttcttttcagagtcatgccatgggtaacaatgtctcaaagacaactcattaattctattaaatctagggactcaggcaggaattgaatttatctaagttgttttggagacagtaaatttacaacatatattacttaagatctgtggtagcttcttctatatttcattttgcatgccccctcactaatatggcaaaggttgttttagcttccaaacagcccttattaaaccagaaaaagacaaggtgaggctcacattgcccaaatgtgggacaaatattaataatacttaaactttatgttgataaaaggttggggggaaagcttctcatatagatcaagaagaat

SEQ ID NO: 326957 - DNA, 2788 bp, Homo sapiens
gcgttttgggaggaggtggtcaccccctgggcccggctgcaggagcgcgggctgcgatctgtgtcccagttcgagctgtgaacccggcgttccccacggcttagactcgccgcgcggtagtgaacttgggacccggactcagtgcccgggctgcggcgcggaccagaattgtccaggacaaactgggctagaaatgacctggcgagggttccatcaaacaaggaaattagctttagatatatcaacaaatctaactaaatacagaggattaatgaagacagagtctaagtagttcagtgactactaaggtggtgtttataatatgatcaaaagtttcagatactgtctgatgcataaaatctattcactgggtaaacaaattggaagcatggagaattcattatttaataagggtgaaggaactggcaaatttgcgaatgacagcattggtgtaagctactctaattttatttgagagctatgaaacaaaatgcctacttttcctggggagatttgggaagacgtcactgagaagatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagaatgggagaaagctggagaagtaagtagggaggtttgggaaaaagctggaaaacaaggactgcttggtgtcaatattgcagagcatcttggtggaattggaggggatctgtactccgcagctattgtctgggaggagcaagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaagtgacttacagggaataaaaacaaatgctaaaaaggatggaagtgactggattctcaatggaagcaaggtgttcatcagtaatgggtcattaagtgatgttgtgattgtagttgcggtcacaaatcatgaagctccctcccctgcccatggtattagcctttttctggtggaaaatggaatgaaaggatttatcaagggacgaaagctacataaaatgggattaaaagcccaggataccgcagaactattctttgaagatatacggttgccagctagtgccctacttggagaagagaataaaggcttctattacatcatgaaagagcttccacaggaaaggctgttaattgctgatgtggcaatttcagctagtgaattcatgtttgaagaaaccaggaactatgttaaacaaagaaaagcttttggcaaaacagttgctcacctacagacagtgcaacataaattagcagaattaaaaacacatatatgtgtaacccgagcatttgtggacaactgtctccagctgcatgaagcgaaacgtttggactccgccactgcttgcatggcgaaatattgggcatctgagttacaaaatagtgtagcttacgactgtgtacagctccatggaggttggggatacatgtgggagtacccaattgcaaaagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggaaataaaatataaatataagattaacacagtggaaggacaaatctttgaagccaaaattctagttttccaatataaggtttaacttacagttttttatgtagccaaaggtaaacggttttctgaatcttgcctaggtgtttcatttatctctaaaattctaaaaagcataaatcattcaaatcttcaaaccaaggcagaaataattttatgtcgctatagtataaaaacattaataagatagcacattgacttttaaagggaaaagtaaatataacttagcatgtaaactcatttcggctaccatttgctccaaattccctagaacagtggtttttaccactgtactccaaccccgtttttaagcaatggaactctttcttcaaacaaaagcttatgcagaacatctctgtgaaacgctgctgagtgagaactgctttcattgaagctggaagccatcataccttactgccttgaaacccctaggactcagctaagtatttgcctaaccctgaccagggaatgccttggttctgtcaattgctgacatctgagaacacagaataatccatcatttttaatttcaagatattggtacattttataggtatcaaagcaatggcttttcttttgcaacagttaatgtatttattaacttaataattactttatgtcttctataaaccaggctgttaatacaatgatgacaaacaaaactggcaagatcactaaaaaataagtgaataaacaaataagtagtaaaataaggtaagaagtaaatatgtaaaagagataatttcaagcataagtgcaatgtaaataataaagtaagcatttaaaattcaaaagtgaggaaatgacatttgatttaagacttaaaagtaattacaaaaaataaaccattaatttaaagt

SEQ ID NO: 326958 - DNA, 1653 bp, Homo sapiens
cgaccagcctgtggcgtggttggggctccggaagggcgcgcgcgagcgcttttttgggaggacaccacaggtggacgcctcagctgatcgtcctccctcccggggaccctgccccgagtcgccgagtagccgcagagtcgcctccgtcgccccgccgcccctgtgtttcggacatggccgcacgccttctccgagggtccctacgcgtcctgggcggccaccgtgcgccgcgccagctgcccgccgcgcgatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagaatgggagaaagctggagaagtaagtagggaggtttgggaaaaagctggaaaacaaggactgcttggtgtcaatattgcagagcatcttggtggaattggaggggatctgtactccgcagctattgtctgggaggagcaagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaagtgacttacagggaataaaaacaaatgctaaaaaggatggaagtgactggattctcaatggaagcaaggtgttcatcagtaatgggtcattaagtgatgttgtgattgtagttgcggtcacaaatcatgaagctccctcccctgcccatggtattagcctttttctggtggaaaatggaatgaaaggatttatcaagggacgaaagctacataaaatgggattaaaagcccaggataccgcagaactattctttgaagatatacggttgccagctagtgccctacttggagaagagaataaaggcttctattacatcatgaaagagcttccacaggaaaggctgttaattgctgatgtggcaatttcagctagtgaattcatgtttgaagaaaccaggaactatgttaaacaaagaaaagcttttggcaaaacagttgctcacctacagacagtgcaacataaattagcagaattaaaaacacatatatgtgtaacccgagcatttgtggacaactgtctccagctgcatgaagcgaaacgtttggactccgccactgcttgcatggcgaaatattgggcatctgagttacaaaatagtgtagcttacgactgtgtacagctccatggaggttggggatacatgtgggagtacccaattgcaaaagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggacacactctctcgatatacgattaaaacacaaaccacttccgcctatttggcctatagcgcc

SEQ ID NO: 326959 - DNA, 341 bp, Homo sapiens
tgtgttttgtttttttggaaaaaataatattcacttcaatattcactgggttattggaagatttaaatgagaccattctctacattttttgtatggtctcttaggataccgcagaactattctttgaagatatacggttgccagctagtgccctacttggagaagagaataaaggcttctattacatcatgaaagagcttccacaggtcagaagtgtttaaagattccatcttttgactgaataatgaattggaatagaataatatagaaacatgttatttctatattatgcattcaaatttatacatgcaaaacttgtgaaatagctaatcatttgagta

SEQ ID NO: 326960 - DNA, 596 bp, Homo sapiens
cgaccagcctgtggcgtggttggggctccggaagggcgcgcgcgagcgcttttttgggaggacaccacaggtggacgcctcagctgatcgtcctccctcccggggaccctgccccgagtcgccgagtagccgcagagtcgcctccgtcgccccgccgcccctgtgtttcggacatggccgcacgccttctccgagggtccctacgcgtcctgggcggccaccgtgcgccgcgccagctgcccgccgcgcgatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagaatgggagaaagctggagaagtaagtagggaggtttgggaaaaagctggaaaacaaggactgcttggtgtcaatattgcagagcatcttggtggaattggaggggatctgtactccgcagctattgtctgggaggagcagtaagtatggagacttttaaggttgagtcttgttttgtaaacacaccactca

SEQ ID NO: 326961 - DNA, 2542 bp, Homo sapiens
cgaccagcctgtggcgtggttggggctccggaagggcgcgcgcgagcgcttttttgggaggacaccacaggtggacgcctcagctgatcgtcctccctcccggggaccctgccccgagtcgccgagtagccgcagagtcgcctccgtcgccccgccgcccctgtgtttcggacatggccgcacgccttctccgagggtccctacgcgtcctgggcggccaccgtgcgccgcgccagctgcccgccgcgcgatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagaatgggagaaagctggagaagtaagtagggaggtttgggaaaaagctggaaaacaaggactgcttggtgtcaatattgcagagcatcttggtggaattggaggggatctgtactccgcagctattgtctgggaggagcaagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaagtgacttacagggaataaaaacaaatgctaaaaaggatggaagtgactggattctcaatggaagcaaggtgttcatcagtaatgggtcattaagtgatgttgtgattgtagttgcggtcacaaatcatgaagctccctcccctgcccatggtattagcctttttctggtggaaaatggaatgaaaggatttatcaagggacgaaagctacataaaatgggattaaaagcccaggataccgcagaactattctttgaagatatacggttgccagctagtgccctacttggagaagagaataaaggcttctattacatcatgaaagagcttccacaggaaaggctgttaattgctgatgtggcaatttcagctagtgaattcatgtttgaagaaaccaggaactatgttaaacaaagaaaagcttttggcaaaacagttgctcacctacagacagtgcaacataaattagcagaattaaaaacacatatatgtgtaacccgagcatttgtggacaactgtctccagctgcatgaagcgaaacgtttggactccgccactgcttgcatggcgaaatattgggcatctgagttacaaaatagtgtagcttacgactgtgtacagctccatggaggttggggatacatgtgggagtacccaattgcaaagaaccctgatgaatatggagaagaataagtccaaaagtgagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggaaataaaatataaatataagattaacacagtggaaggacaaatctttgaagccaaaattctagttttccaatataaggtttaacttacagttttttatgtagccaaaggtaaacggttttctgaatcttgcctaggtgtttcatttatctctaaaattctaaaaagcataaatcattcaaatcttcaaaccaaggcagaaataattttatgtcgctatagtataaaaacattaataagatagcacattgacttttaaagggaaaagtaaatataacttagcatgtaaactcatttcggctaccatttgctccaaattccctagaacagtggtttttaccactgtactccaaccccgtttttaagcaatggaactctttcttcaaacaaaagcttatgcagaacatctctgtgaaacgctgctgagtgagaactgctttcattgaagctggaagccatcataccttactgccttgaaacccctaggactcagctaagtatttgcctaaccctgaccagggaatgccttggttctgtcaattgctgacatctgagaacacagaataatccatcatttttaatttcaagatattggtacattttataggtatcaaagcaatggcttttcttttgcaacagttaatgtatttattaacttaataattactttatgtcttctataaaccaggctgttaatacaatgatgacaaacaaaactggcaagatcactaaaaaataagtgaataaacaaataagtagtaaaataaggtaagaagtaaatatgtaaaagagataatttcaagcataagtgcaatgtaaataataaagtaagcatttaaaattcaaaagtgaggaaatgacatttgatttaagacttaaaagtaattacaaaaaataaaccattaatttaaagt

SEQ ID NO: 326962 - DNA, 1434 bp, Homo sapiens
gcgttttgggaggaggtggtcaccccctgggcccggctgcaggagcgcgggctgcgatctgtgtcccagttcgagctgtgaacccggcgttccccacggcttagactcgccgcgcggtagtgaacttgggacccggactcagtgcccgggctgcggcgcggaccagaattgtccaggacaaactgggctagaaatgacctggcgagggttccatcaaacaaggaaattagctttagatatatcaacaaatctaactaaatacagaggattaatgaagacagagtctaagtagttcagtgactactaaggtggtgtttataatatgatcaaaagtttcagatactgtctgatgcataaaatctattcactgggtaaacaaattggaagcatggagaattcattatttaataagggtgaaggaactggcaaatttgcgaatgacagcattggtgtaagctactctaattttatttgagagctatgaaacaaaatgcctacttttcctggggagatttgggaagacgtcactgagaagatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagaatgggagaaagctggagaagtaagtagggaggtttgggaaaaagctggaaaacaaggactgcttggtgtcaatattgcagagcatcttggtggaattggaggggatctgtactccgcagctattgtctgggaggagcaagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaagtgacttacagggaataaaaacaaatgctaaaaaggatggaagtgactggattctcaatggaagcaaggtgtgtaaaagaggacttctatagcccttcttttcagagtcatgccatgggtaacaatgtctcaaagacaactcattaattctattaaatctagggactcaggcaggaattgaatttatctaagttgttttggagacagtaaatttacaacatatattacttaagatctgtggtagcttcttctatatttcattttgcatgccccctcactaatatggcaaaggttgttttagcttccaaacagcccttattaaaccagaaaaagacaaggtgaggctcacattgcccaaatgtgggacaaatattaataatacttaaactttatgttgataaaaggttggggggaaagcttctcatatagatcaagaagaat

SEQ ID NO: 326963 - DNA, 666 bp, Homo sapiens
gctaatttttaaatttttttagtgacaagatctccctatgttgctcaggctgttctggaactcctgagctcaaatcatcctcctgtctgggcctcccaaagtgctgagattacaggcatgacccaccacgcctggttgctgtgtggtactcttgactttgctttctgccaatcggccttaattaccttatctttttagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctt

SEQ ID NO: 326964 - DNA, 946 bp, Homo sapiens
gctaatttttaaatttttttagtgacaagatctccctatgttgctcaggctgttctggaactcctgagctcaaatcatcctcctgtctgggcctcccaaagtgctgagattacaggcatgacccaccacgcctggttgctgtgtggtactcttgactttgctttctgccaatcggccttaattaccttatctttttagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttagtaagcatactttaatcagtttttctccttgaattaatcttttctcttaatttttattatgtactagttgtattaaagctaatgtgtttacttttaaaaacaacgaacgaccaattaacacccgaatcgaatgaagaaaagaactagtacgcacaaaaaaaggggggggggcgaaaaaaattcccggggggacaaatatgcacaccggttttttgcaaagggggccccataggaggatataaaaaaaaaggggcggatttaaaacggtgaggagaaca

SEQ ID NO: 326965 - DNA, 494 bp, Homo sapiens
gctaatttttaaatttttttagtgacaagatctccctatgttgctcaggctgttctggaactcctgagctcaaatcatcctcctgtctgggcctcccaaagtgctgagattacaggcatgacccaccacgcctggttgctgtgtggtactcttgactttgctttctgccaatcggccttaattaccttatctttttagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctata

SEQ ID NO: 326966 - DNA, 618 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagaggtgggtttgctgcttgagaaaagccttttctcagctttccgtaggggtggaacctgttcctggtcgccaatggtggcgactcagaaggtgtctcatcctgggcattcgggccgaaggtacctgaagcccagacctggcgtccactgagggagggggcgacggagtgggggcggggagggtt

SEQ ID NO: 326967 - DNA, 431 bp, Homo sapiens
ttacaggcatgtgccaccacacttggctaatttttttgtatttttagtagagacagggtttcaccatgttggtcaggctgatctcaaactcctaacctcaaatgatccaccctcctcggcctcccaaatagctgggactacaggcgcacataccatcatgcctggctaattttagtattttttggtacagatggggtttcgccatgttggtcaggctggtctcgatctcctgaccttaagcgatctccccgccttggcctccacatttcttctcaattatgtaataaaaagactaattcggaggtacactcgcataagaaagcagaacagcttaagcaaagagagtgttaccttgctgagggaaaagaaggaattaatttttattgccacctttgtgtcacatgctgtgtctccagcattatcgcccctag

SEQ ID NO: 326968 - DNA, 1779 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttagtaagcatactttaatcagtttttctccttgaattaatcttttctcttaatttttattatgtactagttgtattaaagctaatgtgtttacttttaaaaacaacgaacgaccaattaacacccgaatcgaatgaagaaaagaactagtacgcacaaaaaaaggggggggggcgaaaaaaattcccggggggacaaatatgcacaccggttttttgcaaagggggccccataggaggatataaaaaaaaaggggcggatttaaaacggtgaggagaaca

SEQ ID NO: 326969 - DNA, 1088 bp, Homo sapiens
tccccccacctcggcctcccaaagtgctaggattacaggcgtgagccactgcgcctggcctttttttccatcattttttaaaccttgttttcattacaatgtcacggtagctcctccaacagtatgtttaatcttacccctggtaaatgttacctttttcttgctacagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctt

SEQ ID NO: 326970 - DNA, 1327 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctata

SEQ ID NO: 326971 - DNA, 1393 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcgttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctt

SEQ ID NO: 326972 - DNA, 1404 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctt

SEQ ID NO: 326973 - DNA, 939 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattccctagccatgccgctgcggagataataatgtcattgaatcaaaagcatctgtagggtatccagaaggagcattcatgaagatgttacaagcccgg

SEQ ID NO: 326974 - DNA, 527 bp, Homo sapiens
attatcgcccctagcccttacagcaaccctgtgggactggtgttgtcatcacctctgtttcaccgctgagatcacaggaagcttccgagtggaggctgagccagagctgtctggctctagtgcctgtgccattccactcacattggcttgcaacttggccctgactactgatgataaagcctgggagatagtatctgtgaagtacctagcttggtgcctggcacatacttagaaaatgttcctcccaacagcctcacccatcctcagtcaccttccacccttctgttggaagcatagcctccaccaataatttcttctcaaactatttttaacaggacctcggacagtgatccaccctaaagcaagaattattgcggaagccgggccaatagtgattggcgaagggaacctaatagaagaacaggcccttatcataaatgcgtaagactcttatacatactgtgaaccaagtaccatgggtaacggtttttcttaatttcagctgtctgtaagaaccttttcagctg

SEQ ID NO: 326975 - DNA, 1499 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctt

SEQ ID NO: 326976 - DNA, 2165 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttagtaagcatactttaatcagtttttctccttgaattaatcttttctcttaatttttattatgtactagttgtattaaagctaatgtgtttactttttcctcttgtggatttgtagctgtttaaaatttcaggtgaatttcagtagctattgaattaatttagacttcacttgtttttaagaaaagtacaattttttcttttggtaaaacaaaagtaatcagggaaagatgttttcagtagaatacaaattagtggcattcttgggtttctgaggacaatgaaactaaaagaaattttgaaattatacaaatttatgaaattattaatattttagcatagtgctaatcactaatcattgagctttattattctgttgtctatgtagtgagcaaaatgttgagaattttataattccaaatttttaaaataattcaagtgcataaatttactggaacatacttctcaacttttgaattagtagatattgactaatactaagatactaaaatactaagatattctctcaaaatttaatttttatttatttattttagagacaaggatctcactctattacctaggctggagtgcagtggcacagtctgctcacatggatcacttgacctcctcaaactcaagtgatcctcccgcctcagcctcttgag

SEQ ID NO: 326977 - DNA, 950 bp, Homo sapiens
ccggaattcccgggatggaaactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctt

SEQ ID NO: 326978 - DNA, 1230 bp, Homo sapiens
ccggaattcccgggatggaaactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttagtaagcatactttaatcagtttttctccttgaattaatcttttctcttaatttttattatgtactagttgtattaaagctaatgtgtttacttttaaaaacaacgaacgaccaattaacacccgaatcgaatgaagaaaagaactagtacgcacaaaaaaaggggggggggcgaaaaaaattcccggggggacaaatatgcacaccggttttttgcaaagggggccccataggaggatataaaaaaaaaggggcggatttaaaacggtgaggagaaca

SEQ ID NO: 326979 - DNA, 704 bp, Homo sapiens
gaaattcggccattatggccggaaatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctt

SEQ ID NO: 326980 - DNA, 761 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagaggtgggtttgctgcttgagaaaagccttttctcagctttccgtaggggtggaacctgttcctggtcgccaatggtggcgactcagaaggtgtctcatcctgggcattcgggccgaaggtacctgaagcccagacctggcgtccactgagggagggggcgacggagtgggggcggggagggtt

SEQ ID NO: 326981 - DNA, 1103 bp, Homo sapiens
cggactggattgcaataaacagcttttattcttttatcagagacacgatctagctttttagcccaggccggagtgcggtggcatcctcacagctcgctgcagcttcactgggctcaggcgatcctctcgagtagctggggtacaggcgcaggccaccgtgacaggcttttttttttttttttttttttttttgaagagagggtctcactatgttacccaggctagtctcgcagtctggcactcctggcctcaagcgatcctcctgcctcggcctctcggcctcccaaagtgctggcctgtgcccagtcaatggctgttccaaattagggtctacccatctctatgcagggctaaagtccgcgggcggccccgcaccgctaccaaaagtacagtcctgtgcgcccagacgcgacgcacacaagagtcgcaagcttccgggtccccgccccaccccggctccgcccctcccccaaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggtaagaaatagtttatttactgtttttcaagaattgatgtgatttaatctattttagtgctttacaattagataccgtcttccatgtttatttcactgatgtcctagttttattgacaaaataatgcattttctcctatgtgtttaaatttctgaaagaatgtagtgtgatggaggctgtgtttaaactcctatctgaaatactaatgaggctgtataacaaagtcattcatgtatttaagagagatctgttgtgtacctgcgatgtgccaggcactgtgctagtgctagagacacgtcagtaagcacagcagacaaaggtgctgcctttgtggagcttcgtggagagcgtgggccatggagtcaacagacctgggctactctgctccttgctcctttcttgctgggttactttgaacatattacttaacctctctaaccttgatgtttttcccatct

SEQ ID NO: 326982 - DNA, 708 bp, Homo sapiens
gattcctgcggaacgactctcttaattatcaccgctacaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326983 - DNA, 571 bp, Homo sapiens
gggacctgagtgatattgaggggctgcagcaggctcataacctcctccatgatggccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326984 - DNA, 531 bp, Homo sapiens
aaggaagtcaccggggaggggatggtgagatgacgcactaaagtaaaactccttgtttgtaaaaggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326985 - DNA, 1079 bp, Homo sapiens
gattcctgcggaacgactctcttaattatcaccgctacaggctgaaggaaggcaagggctgaaacggagacaggatgctactgcagtactccacgtgaaggctggtggtcgcttggactgagtcagaacagggaaactgatgggaagttgtcggagagtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggtacttctgcataactacccagtagagaaggatcctttcacaaaaggtgtgggaaaactatactacaagcctgcagtaaccaaaatggcatgttacgggtacaaaaacagacacataggccaatggaacaggttagagaagccagaaataaagccacacacctacaaccatctgatctttggcaaagccaacagtaaaaaacaatggggaaaggactcccaattcaataaatgctgctgggataactgactagccatatgcagaagattgaaactggactccttcctctcaccatacataaaaatcaacccaagattgattaaagacttaagtgtaaaacctaaaattataaaaatcctacaagaaaaccttggaaataacattctggacattggccctggcaaagacttcatgatgaagactccaaaagtaattgtaacaaaaacaaaaatcgacaagtgggacctaattaaagagttttgcacagtaaaagaaactatcaacagagtaaatagacaacctacagaatggaagaaaatatttgcaaactacgtatctgacaaaggtgtaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcatta

SEQ ID NO: 326986 - DNA, 1959 bp, Homo sapiens
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagagttcctaccattttgtggttccagcagcttctgttccagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326987 - DNA, 1950 bp, Homo sapiens
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaagatctctgatttttagtgtgttca

SEQ ID NO: 326988 - DNA, 1981 bp, Homo sapiens
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaattggtgatgcgagcaagtttctcctggttctctgcgacaaagaagtgaaactatgtgaaatgaa

SEQ ID NO: 326989 - DNA, 1971 bp, Homo sapiens
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaattctgtgcgatgcggccgcccctttccccttgttcagctgcccccggtttgttg

SEQ ID NO: 326990 - DNA, 965 bp, Homo sapiens
gattcctgcggaacgactctcttaattatcaccgctacaggctgaaggaaggcaagggctgaaacggagacaggatgctactgcagtactccacgtgaaggctggtggtcgcttggactgagtcagaacagggaaactgatgggaagttgtcggagagaggatgagaaaaccagccaagaaaaatgagaaggatcatccagtaaagcataaaaagagccaagagtctgaggttccagaagccaaggcaagaatgcatttccaggagtaaacaaatgtcaagtgcagctccatcacaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326991 - DNA, 825 bp, Homo sapiens
gattcctgcggaacgactctcttaattatcaccgctacaggctgaaggaaggcaagggctgaaacggagacaggatgctactgcagtactccacgtgaaggctggtggtcgcttggactgagtcagaacagggaaactgatgggaagttgtcggagagtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326992 - DNA, 1078 bp, Homo sapiens
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtcggtgaactatgggtgcgagttcatc

SEQ ID NO: 326993 - DNA, 858 bp, Homo sapiens
gaaaaatgcattttagtttcctcagcattcacaatgtagaaccttccagagaagctttcttttctttctggcatctggataaatggaggaatagcacgaagcgattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagtgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326994 - DNA, 693 bp, Homo sapiens
gattcctgcggaacgactctcttaattatcaccgctacaggctgaaggaaggcaagggctgaaacggagacaggatgctactgcagtactccacgtgaaggctggtggtcgcttggactgagtcagaacagggaaactgatgggaagttgtcggagagaggatgagaaaaccagccaagaaaaatgagaaggatcatccagtaaagcataaaaagagccaagagtctgaggttccagaagccaaggcaagaatgcatttccaggagtaaacaaatgtcaagtgcagctccatcacaggtaaatatttccaactacagtctggtgatggagtctgacgcaggaaccttcttacccactgggctgcaattcactggcaaagacttcatgatgaagactccaaaagtaattgtaacaaaaacaaaaatcgacaagtgggacctaattaaagagttttgcacagtaaaagaaactatcaacagagtaaatagacaacctacagaatggaagaaaatatttgcaaactacgtatctgacaaaggtgtaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcatta

SEQ ID NO: 326995 - DNA, 1919 bp, Homo sapiens
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326996 - DNA, 1858 bp, Homo sapiens
gaaaaatgcattttagtttcctcagcattcacaatgtagaaccttccagagaagctttcttttctttctggcatctggataaatggaggaatagcacgaagcgattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326997 - DNA, 1980 bp, Homo sapiens
  misc_feature (1943)..(1943): n is a, c, g, or t
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaattagtagttaaacggccagcctctcnctttccctgctccgtcgtagattggagtgggaggtgt

SEQ ID NO: 326998 - DNA, 1861 bp, Homo sapiens
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggatgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 326999 - DNA, 791 bp, Homo sapiens
agaaaagggaaaagaaatgggcatgtttcagggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatt

SEQ ID NO: 327000 - DNA, 2173 bp, Homo sapiens
cgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggttggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggtacttctgcataactacccagtagagaaggatcctttcacaaaaggtgtgggaaaactatactacaagcctgcagtaaccaaaatggcatgttacgggtacaaaaacagacacataggccaatggaacaggttagagaagccagaaataaagccacacacctacaaccatctgatctttggcaaagccaacagtaaaaaacaatggggaaaggactcccaattcaataaatgctgctgggataactgactagccatatgcagaagattgaaactggactccttcctctcaccatacataaaaatcaacccaagattgattaaagacttaagtgtaaaacctaaaattataaaaatcctacaagaaaaccttggaaataacattctggacattggccctggcaaagacttcatgatgaagactccaaaagtaattgtaacaaaaacaaaaatcgacaagtgggacctaattaaagagttttgcacagtaaaagaaactatcaacagagtaaatagacaacctacagaatggaagaaaatatttgcaaactacgtatctgacaaaggtgtaatatctagaatctataaggaacttaagcaattcaacaaactaaaaacaaacaatcccattaaaaagtgggcaaaagacatgaacagacacttctcaaacgaagacagacaagcagccaacaaacatatgaaaaaatgctcaacatcatta

SEQ ID NO: 327001 - DNA, 856 bp, Homo sapiens
gattcctgcggaacgactctcttaattatcaccgctacaggctgaaggaaggcaagggctgaaacggagacaggatgctactgcagtactccacgtgaaggctggtggtcgcttggactgagtcagaacagggaaactgatgggaagttgtcggagagtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaagatctctgatttttagtgtgttca

SEQ ID NO: 327002 - DNA, 146 bp, Homo sapiens
accttccaaacaaaagcagcagaaagcttacagaatacattagaaaacatataaaatcttatggttactgacttctaatatattttaaaataatgcagcatattttcacggtaaaaaaatggcgtaagtgcttgagtgattttctg

SEQ ID NO: 327003 - DNA, 253 bp, Homo sapiens
cggcacgagcaacgaatcaggaggttgcgcatgagaagggctgtgagagacggacagagaaagagtcctggagccgctaggccagctggggtaggggaatagggagtgggctcaagaggcaactgggcaggcctgattccttccctgctgagcaagctgatttcatgtaagtcttagcaccaacttacctctaacttcacttcaaaggtatccatagttcatcctgtcctgaaggaccggtccagcccagccc

SEQ ID NO: 327004 - DNA, 783 bp, Homo sapiens
gggaagttggacccaaagacacatacacacagagggaagacaatgtgaagacaaagagaagactgtcatgaaggcaaaaactgtggtgatgaatttacaagccaaggagtgccgaagattgccagcaaaccaccagcatctaggagagaggcacgaaatagattctccctcacagcgctcagaaggaagcaagtctcctgacaccttgaactcggccttctatccttcagaactgtgaggcaataaatgcctgttgtttaagatacctacttgggggtccttagttatggcagccctagtaaacgcacatactctgttttaattttatctttctgtctactttcttgtttacttacagtcatgtgtcacttaacaacctggatatgtcctgagaaatgcatcactagacaattttgtcattgtaggaacatcatagagcttactttcacaaaccaacatggtacggcctactacacacttaggctatatggtacagcctattgttccctaggccactaacctgtacagcatgttatgatactgaataccgtaggcagttgtaacacaatgatatttgtatatctaaacatctgtaaacatagaaagaatgctgtagaaatatggcataaaggataaaaaatgatacagtatatgggacatttatcacaaatggaacctgcaggactgggagttgctctgcaagaataaattattaagttctgagtgaatatgaaggcctaggacattgctgtacactactgcagactttatacatgctgttca

SEQ ID NO: 327005 - DNA, 483 bp, Homo sapiens
ttatcctttcagagatttattacacagttccttattaaaataaagttggttacaggtacttcacacattctaatgcttttcttttcatttatctcaacatgacctaaagaatgtctggctatactttctcaatgccttacatgcagtctttgattcctgtagcaaggctttaagtgagcagtactgcaggtaaagcaaaaatgtggtgagcaaagctgacaccaaagctagtggttaaatagctacaagctaacagacatataatcaatacctaaccccaccagcaacattaaagcaaatgaactagtattttctaaatacctagcatagtacctattatatgtattttactgtacactgcagttccttttacaaaatagacaacatatttagtctttttttgatttaaaaaaaaagggattctttgtctaccaggctttctaacataatgatacacaatcctgagtcaccctggacttaacc

SEQ ID NO: 327006 - DNA, 1646 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327007 - DNA, 1752 bp, Homo sapiens
gaattcgggtctcgagcaggaagtaccaagggaggatggagatggtaataatcagggttgggtggagaatatctgaggaaactgcacttgatttgggccttgaagagtaattgactggatttagatttatctagaaaggtcgttcccagcagaagcaacaagaacaacaagcttggaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattcaaaaaacaacacacacaacaacaagcaaaaaaaccgggacatagggggggaaaaaatataagggccagcgtgtaacacggtcgctacacccttttttcacaggggaaacggggcgcccaaagggggaatatacacatggtacatagtttacagagagtacattttgtatatctatactaatgacccaattaccattctggagtaacacatgcttcttcacctagagcacatcatctcatgtgcaatcggatagactctctcatatgtgtctgtacttctggttataccgatcgcg

SEQ ID NO: 327008 - DNA, 1964 bp, Homo sapiens
ccatggattcgtggctaaactgcacatgtttattttctcagagttctgaggttggaggttggaaatgggttccgcagggccaggctcctccagaggatcctccttgcctttccagctactgcagctgtggtccttgcgtttcttggcttgaggcccttcatcttcaaggccagtggagtggcattttgctttattctttgcattgctttttcccgtgagatctccccctccctccctcttagaaggatacctgtgattacatttagggtcaactggaacaatccaggataatctcccatctcaagagcctgaatctaatcgtgctgcacagtcccttttgccatgtaaggggcattcacaggtcccagggattatgacccaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctccccttccttgttccgtgggttcccactcactgctcaagtgagtcactgggactgtcttagaatgctggcattctctgactgggacatattcatttggtaaacatctgagaactgtgtcagagcaggcaggccccgcatccctgcattcctgcatcccctccttcccagcctgactgcctgtggggcccttagctgccccttgtcctctcacctgattctgcagattcttcttcttgagcagcagctcagaaagcgcatccgccctgcgtttcaagcccagctacttcttagcttcacttccgtcaacttcaccttccctgtagtgcagtggggcattgatggtaggtctctctaagggcttggtggactttaacatgtgattctgtgattccgacttgcctgaagataccccagctcccccctcccgactatccagctgcattcctgctctggaccctgctggggctgccacacccactgcacggcagggctagagagatgtgcagcctgaccctacccctgagcctgtctgtgaaggtggagatgggcatgcacccacagcccatgaggcaaggtggtgtcctgagtgtgctgtgagttcaggcgcaggaaggcctggcttgttgcagcaggatgtccccaagcgtggtccaaaattggggctttgccacctgcagggatttcctagaaggagatccaagggtcaggaggcatttgaaaggctttcacgcatctttgtatgtggcttgattgatccttttttaaggctcttgctacccagaaatgggattctctctctcattataaaaacatttggccatcttttcttgtgtaactgtcagtgaatgtatcattttgaatatttttcaaattaaaacagtacatttaagcccgcaaaacacaccaaagaatacaaacatagaagcaaaagccagtgccccttctgtaattccaccccaaggaagagactccaggaaagggtgcctccttcccactttctccacgtgcgggcaggcgtgcagggaggagtcctcacaaaacagggcggcgtttcacatagaactctttcattttccacacttaacattagaaacacacaaaataatgtggagggtcctaaaaagaaacagccagagttctgtgtgtgtttctgcttgcccactgaaccacagcatcggcggtgactgtcggtaaggcgcgtgagatgcagtcgcgtggaagctgtgcttaagtgatactgattttaaatcttgttccaggtctgccatcatggatgttctcgcagaagcaaatggcacctttgccttaaaccttttgaaaacgctgggccatctgtgcagcggtgtttccctttgcccccatgtagaccatggccagggcacaggacatgctcatgggtgagaaaaacacattcttcgagttctgatc

SEQ ID NO: 327009 - DNA, 731 bp, Homo sapiens
cttagctatcttatttactgaagctaaagaagtaggtccttaaaaagccattgacaggtcttgagtttgcaacgtgactgtgaaacaggcatccttgttactcacacgtttgctgaaaggataacagaaagccctcgatagaaaaatctcactagattgtttataatttgttgatatttggagtatcttgagtggtaaactttaaatgtggatttattttttctttccttttaggatttggatctctccaatcttttttatgattaattgttcagtgtttatgcattattgcgaagtgataatgaaaatgctcaaactcagggtcctgcaggcactgtgggggaggcagtggggacgtgaggggattacagatccagtagaagccccccgacccccatctgcttccaccccatctccttccagaacaccaccgatagccacaccgaagagttctcccatttgctggttcccggacaaaaaagctgctgatcccttgagcacactgcagtgaagctcccagctgacatgtcctgtccatgtaaacagaacttcctccattctgcttctcagactctattccgacaccctccaacatggaggaaacgcaacagaaatccaatctagagctgctccgaatctccctgctgctcatcgagtcgtggctggagcccgtggggtcctcaggagtatttcgcaacaactgtggttgaactcggcaggatgatatactc

SEQ ID NO: 327010 - DNA, 1604 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327011 - DNA, 1889 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtttgtcgctccaaagtcgggaaagccgggggcgcgagcggggaggggggcagggtgggggtcgcgcggggccgggaacgcgcgtgggtcgacggcgcgcggggacgctggagccccgagaatggggcgtggccgcgcggggctgtgaccccagcagtcccagcggggcgggggcccgggcgagcgtccggcttgggttcccttccggagcctcgcagcggcagagaacggcgacgcggccgggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327012 - DNA, 1318 bp, Homo sapiens
  misc_feature (1)..(1): n is a, c, g, or t
  misc_feature (23)..(23): n is a, c, g, or t
  misc_feature (25)..(25): n is a, c, g, or t
  misc_feature (30)..(30): n is a, c, g, or t
ntcgtatcggcatcgactctctncntaacnaccgacaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327013 - DNA, 1325 bp, Homo sapiens
cagccgtcattctgccattgttgccctgggttctctggagacatggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327014 - DNA, 2576 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtttgtcgctccaaagtcgggaaagccgggggcgcgagcggggaggggggcagggtgggggtcgcgcggggccgggaacgcgcgtgggtcgacggcgcgcggggacgctggagccccgagaatggggcgtggccgcgcggggctgtgaccccagcagtcccagcggggcgggggcccgggcgagcgtccggcttgggttcccttccggagcctcgcagcggcagagaacggcgacgcggccgggtgagtcgtgcgtggccgcgagcccggccggtgacgccgcggacccgaggaccccgggcgcccaggcccagcgcccacggaagaggcggccggcgcgggatgggggcggcgcagagcctcccgggccacaggtgaccccggtcggccccgcggcctcggtgacccctcgcccgctccgcgacccggaggacgcgtgctcagtcttggggcgccgggtgttaggagccgggcgggaggcggagagaggccgaggggttcggcgccaaacggtgccatccgggccccctgcgtgtgttcactggactggccgtgctgggcttggccaatccgcagcactttcaggtcgcccagacctgtggagacgatcgtgtggaccagcccggatctccttaccgctctgtgtttgaattaaactccctacaggcaaactattacaggctttgatgtcttcaaggcaaagaggaaactttaactacaaattggcatttaagttattttcttccttttttttttttttttttttgtcctaaagattggcttgggaaaactgagaacaccaccgatagccacaccgaagagttctcccatttgctggttcccggacaaaaaagctgctgatcccttgagcacactgcagtgaagctcccagctgacatgtcctgtccatgtaaacagaacttcctccatgtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327015 - DNA, 1637 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattcaaaaaaaaaaaaaaaaaaaaaaaaaaaaatttgt

SEQ ID NO: 327016 - DNA, 1597 bp, Homo sapiens
  misc_feature (1551)..(1551): n is a, c, g, or t
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaccggccttaaaatncagacgcagacagcagaggcagacaagcataggcagacaacatacc

SEQ ID NO: 327017 - DNA, 1223 bp, Homo sapiens
ggagtctcactctgtcgccaggctagagtgcagtggcacgatctcagctcactgcaacctccgcctcccgggttcaagcgattctctttcctcagcttcccgagtagctgggttacagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327018 - DNA, 1189 bp, Homo sapiens
tgggattacaagtgtaagccacagtacctgaccttgacttagtttttaagctaggattaaatatagctaaagctaggaagttgtagtttaggttaagtcctcatatttatttgtaaattatgtatgtcaatcataaaattatagattttctgacttggtgcaatgaagaagtaggccgttggtgttcatcatttttgtagccaggcagttatgtcactctgtctatcctagtcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327019 - DNA, 1515 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttcctttttctcctctctgtcccctgacactccacagtgtgcctgcaacccaagtggccttatccgtgcagtggtggcagttcagaaataaagggcccatttgtgggatgccgcattca

SEQ ID NO: 327020 - DNA, 1451 bp, Homo sapiens
ggagtctcactctgtcgccaggctagagtgcagtggcacgatctcagctcactgcaacctccgcctcccgggttcaagcgattctctttcctcagcttcccgagtagctgggttacaggtacgcaccaccaggcccagctcatttttgtgtgtttagtagagatggggttttgccatgttggccaggctgatctcgaactcctgacctcaggtgatcctcccgccttggcctcccaaagtgctgggattataggcgtgagctgctgcgcccagcctcggatagatcttttaagcagtaataagggtctggatggttgttaggctgagtttggggttgccccatttcctgaagtcagagcatacaggaatgatttgttttcattctgtttttgatttcagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327021 - DNA, 1441 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctccaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327022 - DNA, 688 bp, Homo sapiens
tgcggcgtcgatccaagtctccacggtggtcctgaattccatcatcaaggccatgcgtggattgccagctggcatccacagcatagcacagggccctgctgggcagcagcaccctgggtcttaaagtcttcaactgtctccctctaggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327023 - DNA, 634 bp, Homo sapiens
taaaaaaaaaaaaaaaaaaaaaaaaaaaaaaaaaaaaaaggggggggggcctcgtgccgaattcggcacgaggagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327024 - DNA, 2525 bp, Homo sapiens
ccatggattcgtggctaaactgcacatgtttattttctcagagttctgaggttggaggttggaaatgggttccgcagggccaggctcctccagaggatcctccttgcctttccagctactgcagctgtggtccttgcgtttcttggcttgaggcccttcatcttcaaggccagtggagtggcattttgctttattctttgcattgctttttcccgtgagatctccccctccctccctcttagaaggatacctgtgattacatttagggtcaactggaacaatccaggataatctcccatctcaagagcctgaatctaatcgtgctgcacagtcccttttgccatgtaaggggcattcacaggtcccagggattatgacccaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctccccttccttgttccgtgggttcccactcactgctcaagtgagtcactgggactgtcttagaatgctggcattctctgactgggacatattcatttggtaaacatctgagaactgtgtcagagcaggcaggccccgcatccctgcattcctgcatcccctccttcccagcctgactgcctgtggggcccttagctgccccttgtcctctcacctgattctgcagattcttcttcttgagcagcagctcagaaagcgcatccgccctgcgtttcaagcccagctacttcttagcttcacttccgtcaacttcaccttccctgtagtgcagtggggcattgatggtaggtctctctaagggcttggtggactttaacatgtgattctgtgattccgacttgcctgaagataccccagctcccccctcccgactatccagctgcattcctgctctggaccctgctggggctgccacacccactgcacggcagggctagagagatgtgcagcctgaccctacccctgagcctgtctgtgaaggtggagatgggcatgcacccacagcccatgaggcaaggtggtgtcctgagtgtgctgtgagttcaggcgcaggaaggcctggcttgttgcagcaggatgtccccaagcgtggtccaaaattggggctttgccacctgcagggatttcctagaaggagatccaagggtcaggaggcatttgaaaggctttcacgcatctttgtatgtggcttgattgatccttttttaaggctcttgctacccagaaatgggattctctctctcattataaaaacatttggccatcttttcttgtgtaactgtcagtgaatgtatcattttgaatatttttcaaattaaaacagtacatttaagcccgcaaaacacaccaaagaatacaaacatagaagcaaaagccagtgccccttctgtaattccaccccaaggaagagactccaggaaagggtgcctccttcccactttctccacgtgcgggcaggcgtgcagggaggagtcctcacaaaacagggcggcgtttcacatagaactctttcattttccacacttaacattagaaacacacaaaataatgtggagggtcctaaaaagaaacagccagagttctgtgtgtgtttctgcttgcccactgaaccacagcatcggcggtgactgtcggtaaggcgcgtgagatgcagtcgcgtggaagctgtgcttaagtgatactgattttaaatcttgttccaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttcgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327025 - DNA, 1253 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaaggacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327026 - DNA, 931 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaaggcgagtaaggggccgtgacaggag

SEQ ID NO: 327027 - DNA, 1456 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtttgtcgctccaaagtcgggaaagccgggggcgcgagcggggaggggggcagggtgggggtcgcgcggggccgggaacgcgcgtgggtcgacggcgcgcggggacgctggagccccgagaatggggcgtggccgcgcggggctgtgaccccagcagtcccagcggggcgggggcccgggcgagcgtccggcttgggttcccttccggagcctcgcagcggcagagaacggcgacgcggccgggtgagtcgtgcgtggccgcgagcccggccggtgacgccgcggacccgaggaccccgggcgcccaggcccagcgcccacggaagaggcggccggcgcgggatgggggcggcgcagagcctcccgggccacaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtgaaaatgtattgttattctacttttgtaataacctcttaatccattttattgtcagttccttcacaagactgtcaattgtaaacaggaatgatttttttttctctgaataactgcaaacttaaaaaatctgcttctgaaatcagttgccattatttgacattttggaaatgctcaatgtgttctgttctctctgatttctccctgtttccttggtgtacccgtgatgcctttcagtgtttggtatacctcttctggatcaatccacgttttaat

SEQ ID NO: 327028 - DNA, 1079 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtttgtcgctccaaagtcgggaaagccgggggcgcgagcggggaggggggcagggtgggggtcgcgcggggccgggaacgcgcgtgggtcgacggcgcgcggggacgctggagccccgagaatggggcgtggccgcgcggggctgtgaccccagcagtcccagcggggcgggggcccgggcgagcgtccggcttgggttcccttccggagcctcgcagcggcagagaacggcgacgcggccgggtgagtcgtgcgtggccgcgagcccggccggtgacgccgcggacccgaggaccccgggcgcccaggcccagcgcccacggaagaggcggccggcgcgggatgggggcggcgcagagcctcccgggccacaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcagtaagtcatacttgctc

SEQ ID NO: 327029 - DNA, 1843 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtttgtcgctccaaagtcgggaaagccgggggcgcgagcggggaggggggcagggtgggggtcgcgcggggccgggaacgcgcgtgggtcgacggcgcgcggggacgctggagccccgagaatggggcgtggccgcgcggggctgtgaccccagcagtcccagcggggcgggggcccgggcgagcgtccggcttgggttcccttccggagcctcgcagcggcagagaacggcgacgcggccgggtgagtcgtgcgtggccgcgagcccggccggtgacgccgcggacccgaggaccccgggcgcccaggcccagcgcccacggaagaggcggccggcgcgggatgggggcggcgcagagcctcccgggccacaggtgaccccggtcggccccgcggcctcggtgacccctcgcccgctccgcgacccggaggacgcgtgctcagtcttggggcgccgggtgttaggagccgggcgggaggcggagagaggccgaggggttcggcgccaaacggtgccatccgggccccctgcgtgtgttcactggactggccgtgctgggcttggccaatccgcagcactttcaggtcgcccagacctgtggagacgatcgtgtggaccagcccggatctccttaccgctctgtgtttgaattaaactccctacaggcaaactattacaggctttgatgtcttcaaggcaaagaggaaactttaactacaaattggcatttaagttattttcttccttttttttttttttttttttgtcctaaagattggcttgggaaaactgaggtacagaaaattaataattaatgttcacatgctgtcaggaatactcagatgcgagggggcatctgagtccattttttgggcacttttgctttctgggatgctctcgtgcctaatgacagccctgcagctgcctgcatcctttctggtgggggtcaggcctgatgcgatgagatctgatgtgttcagtgaccttctagttaaggtcctgggccggccttgtattgctggggcttttatgtgtgctgggattaacaccagtgactgctgttatcagcatagatggcgtttgttctcatttcaggaccgtatctgagtaattgcatccattgtgatgtgccaccaaagagaaaagtactttggtcatactcgactatgtaaactaagtattttaagttaaggccaattccaatgcattttattacaattcagcatgaaacagttaacacggaccagtaacagtagagtgaaattagcatgaatagaaccaacattcttttccacatatgtaataataagggcacccaagcagatgttgtacggtcccagggaagaccacacaccttacatttccaggcttactgcacttgggattaagccaaggcatccaaagaaagaaaattttttttttttttttttttgccaggctggagtgcagtggtgcgatttcggctgactgcaacct

SEQ ID NO: 327030 - DNA, 3075 bp, Homo sapiens
ccatggattcgtggctaaactgcacatgtttattttctcagagttctgaggttggaggttggaaatgggttccgcagggccaggctcctccagaggatcctccttgcctttccagctactgcagctgtggtccttgcgtttcttggcttgaggcccttcatcttcaaggccagtggagtggcattttgctttattctttgcattgctttttcccgtgagatctccccctccctccctcttagaaggatacctgtgattacatttagggtcaactggaacaatccaggataatctcccatctcaagagcctgaatctaatcgtgctgcacagtcccttttgccatgtaaggggcattcacaggtcccagggattatgacccaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctccccttccttgttccgtgggttcccactcactgctcaagtgagtcactgggactgtcttagaatgctggcattctctgactgggacatattcatttggtaaacatctgagaactgtgtcagagcaggcaggccccgcatccctgcattcctgcatcccctccttcccagcctgactgcctgtggggcccttagctgccccttgtcctctcacctgattctgcagattcttcttcttgagcagcagctcagaaagcgcatccgccctgcgtttcaagcccagctacttcttagcttcacttccgtcaacttcaccttccctgtagtgcagtggggcattgatggtaggtctctctaagggcttggtggactttaacatgtgattctgtgattccgacttgcctgaagataccccagctcccccctcccgactatccagctgcattcctgctctggaccctgctggggctgccacacccactgcacggcagggctagagagatgtgcagcctgaccctacccctgagcctgtctgtgaaggtggagatgggcatgcacccacagcccatgaggcaaggtggtgtcctgagtgtgctgtgagttcaggcgcaggaaggcctggcttgttgcagcaggatgtccccaagcgtggtccaaaattggggctttgccacctgcagggatttcctagaaggagatccaagggtcaggaggcatttgaaaggctttcacgcatctttgtatgtggcttgattgatccttttttaaggctcttgctacccagaaatgggattctctctctcattataaaaacatttggccatcttttcttgtgtaactgtcagtgaatgtatcattttgaatatttttcaaattaaaacagtacatttaagcccgcaaaacacaccaaagaatacaaacatagaagcaaaagccagtgccccttctgtaattccaccccaaggaagagactccaggaaagggtgcctccttcccactttctccacgtgcgggcaggcgtgcagggaggagtcctcacaaaacagggcggcgtttcacatagaactctttcattttccacacttaacattagaaacacacaaaataatgtggagggtcctaaaaagaaacagccagagttctgtgtgtgtttctgcttgcccactgaaccacagcatcggcggtgactgtcggtaaggcgcgtgagatgcagtcgcgtggaagctgtgcttaagtgatactgattttaaatcttgttccaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327031 - DNA, 1792 bp, Homo sapiens
tctcctccgaatatcctggtctggtttctccagttcagtgtttcagattaaatcccctgacacagtaaaactcatgtgcactgacttctcctccgaatatcctgctttggtttctccagttcagtatttcaaattaaatcccctgacacagtgaaactcatgtgcaccgacttctcctctgccccagatggtgtaacctgggctggccagacaggcacctccccagtgggcgtgtcttcagacaaaggtggctttgctttgttgaagttactgatataaagatcagcgcctgaaacagattctccgggatattaccggagacggagtgttttattattagcctttcttaggtggacatttccatttgaattacaagtcctttaggctgggcgtggtgcatggctgtaatctcagcaccttgggaggctgaggcaggaagatcacttgaggccaggcgttggagagcagcctgggcaaggtggcaagaaccttgtctctacaaaaaaaaaagcgtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327032 - DNA, 572 bp, Homo sapiens
tagccggccccacattcgatcgcggagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327033 - DNA, 2020 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtttgtcgctccaaagtcgggaaagccgggggcgcgagcggggaggggggcagggtgggggtcgcgcggggccgggaacgcgcgtgggtcgacggcgcgcggggacgctggagccccgagaatggggcgtggccgcgcggggctgtgaccccagcagtcccagcggggcgggggcccgggcgagcgtccggcttgggttcccttccggagcctcgcagcggcagagaacggcgacgcggccgggtgagtcgtgcgtggccgcgagcccggccggtgacgccgcggacccgaggaccccgggcgcccaggcccagcgcccacggaagaggcggccggcgcgggatgggggcggcgcagagcctcccgggccacaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327034 - DNA, 1370 bp, Homo sapiens
aatgctatgaggcgggtaatcggagaggcggagtttgagtcgggcggtccgggctctgccgcgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327035 - DNA, 1838 bp, Homo sapiens
cttagctatcttatttactgaagctaaagaagtaggtccttaaaaagccattgacaggtcttgagtttgcaacgtgactgtgaaacaggcatccttgttactcacacgtttgctgaaaggataacagaaagccctcgatagaaaaatctcactagattgtttataatttgttgatatttggagtatcttgagtggtaaactttaaatgtggatttattttttctttccttttaggatttggatctctccaatcttttttatgattaattgttcagtgtttatgcattattgcgaagtgataatgaaaatgctcaaactcagggtcctgcaggcactgtgggggaggcagtggggacgtgaggggattacagatccagtagaagccccccgacccccatctgcttccaccccatctccttccagaacaccaccgatagccacaccgaagagttctcccatttgctggttcccggacaaaaaagctgctgatcccttgagcacactgcagtgaagctcccagctgacatgtcctgtccatgtaaacagaacttcctccatgtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327036 - DNA, 1898 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattcaaaaaacaacacacacaacaacaagcaaaaaaaccgggacatagggggggaaaaaatataagggccagcgtgtaacacggtcgctacacccttttttcacaggggaaacggggcgcccaaagggggaatatacacatggtacatagtttacagagagtacattttgtatatctatactaatgacccaattaccattctggagtaacacatgcttcttcacctagagcacatcatctcatgtgcaatcggatagactctctcatatgtgtctgtacttctggttataccgatcgcg

SEQ ID NO: 327037 - DNA, 1504 bp, Homo sapiens
ggagtctcactctgtcgccaggctagagtgcagtggcacgatctcagctcactgcaacctccgcctcccgggttcaagcgattctctttcctcagcttcccgagtagctgggttacaggtacgcaccaccaggcccagctcatttttgtgtgtttagtagagatggggttttgccatgttggccaggctgatctcgaactcctgacctcaggtgatcctcccgccttggcctcccaaagtgctgggattataggcgtgagctgctgcgcccagcctcggatagatcttttaagcagtaataagggtctggatggttgttaggctgagtttggggttgccccatttcctgaagtcagagcatacaggaatgatttgttttcattctgtttttgatttcagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327038 - DNA, 1663 bp, Homo sapiens
cttagctatcttatttactgaagctaaagaagtaggtccttaaaaagccattgacaggtcttgagtttgcaacgtgactgtgaaacaggcatccttgttactcacacgtttgctgaaaggataacagaaagccctcgatagaaaaatctcactagattgtttataatttgttgatatttggagtatcttgagtggtaaactttaaatgtggatttattttttctttccttttaggatttggatctctccaatcttttttatgattaattgttcagtgtttatgcattattgcgaagtgataatgaaaatgctcaaactcagggtcctgcaggcactgtgggggaggcagtggggacgtgaggggattacagatccagtagaagccccccgacccccatctgcttccaccccatctccttccagaacaccaccgatagccacaccgaagagttctcccatttgctggttcccggacaaaaaagctgctgatcccttgagcacactgcagtgaagctcccagctgacatgtcctgtccatgtaaacagaacttcctccatatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327039 - DNA, 1967 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtttgtcgctccaaagtcgggaaagccgggggcgcgagcggggaggggggcagggtgggggtcgcgcggggccgggaacgcgcgtgggtcgacggcgcgcggggacgctggagccccgagaatggggcgtggccgcgcggggctgtgaccccagcagtcccagcggggcgggggcccgggcgagcgtccggcttgggttcccttccggagcctcgcagcggcagagaacggcgacgcggccgggtgagtcgtgcgtggccgcgagcccggccggtgacgccgcggacccgaggaccccgggcgcccaggcccagcgcccacggaagaggcggccggcgcgggatgggggcggcgcagagcctcccgggccacaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327040 - DNA, 2716 bp, Homo sapiens
  misc_feature (1979)..(1983): n is a, c, g, or t
  misc_feature (1985)..(1986): n is a, c, g, or t
ccatggattcgtggctaaactgcacatgtttattttctcagagttctgaggttggaggttggaaatgggttccgcagggccaggctcctccagaggatcctccttgcctttccagctactgcagctgtggtccttgcgtttcttggcttgaggcccttcatcttcaaggccagtggagtggcattttgctttattctttgcattgctttttcccgtgagatctccccctccctccctcttagaaggatacctgtgattacatttagggtcaactggaacaatccaggataatctcccatctcaagagcctgaatctaatcgtgctgcacagtcccttttgccatgtaaggggcattcacaggtcccagggattatgacccaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctccccttccttgttccgtgggttcccactcactgctcaagtgagtcactgggactgtcttagaatgctggcattctctgactgggacatattcatttggtaaacatctgagaactgtgtcagagcaggcaggccccgcatccctgcattcctgcatcccctccttcccagcctgactgcctgtggggcccttagctgccccttgtcctctcacctgattctgcagattcttcttcttgagcagcagctcagaaagcgcatccgccctgcgtttcaagcccagctacttcttagcttcacttccgtcaacttcaccttccctgtagtgcagtggggcattgatggtaggtctctctaagggcttggtggactttaacatgtgattctgtgattccgacttgcctgaagataccccagctcccccctcccgactatccagctgcattcctgctctggaccctgctggggctgccacacccactgcacggcagggctagagagatgtgcagcctgaccctacccctgagcctgtctgtgaaggtggagatgggcatgcacccacagcccatgaggcaaggtggtgtcctgagtgtgctgtgagttcaggcgcaggaaggcctggcttgttgcagcaggatgtccccaagcgtggtccaaaattggggctttgccacctgcagggatttcctagaaggagatccaagggtcaggaggcatttgaaaggctttcacgcatctttgtatgtggcttgattgatccttttttaaggctcttgctacccagaaatgggattctctctctcattataaaaacatttggccatcttttcttgtgtaactgtcagtgaatgtatcattttgaatatttttcaaattaaaacagtacatttaagcccgcaaaacacaccaaagaatacaaacatagaagcaaaagccagtgccccttctgtaattccaccccaaggaagagactccaggaaagggtgcctccttcccactttctccacgtgcgggcaggcgtgcagggaggagtcctcacaaaacagggcggcgtttcacatagaactctttcattttccacacttaacattagaaacacacaaaataatgtggagggtcctaaaaagaaacagccagagttctgtgtgtgtttctgcttgcccactgaaccacagcatcggcggtgactgtcggtaaggcgcgtgagatgcagtcgcgtggaagctgtgcttaagtgatactgattttaaatcttgttccaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagtttctttcnnnnnanntggcggtggtggagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327041 - DNA, 1371 bp, Homo sapiens
  misc_feature (1334)..(1334): n is a, c, g, or t
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctccaggcacggaggctgcagccgccacagctgccatcatgatgatgcggtgtgccagattcgtcccccgcttctgcgccgaccaccccttccttttcttcatccagcacagcaagaccaacgggattctcttctgcggcccagcttatgaactttagtccggattcctctgccggctgctgcaatgttntgctgtttccctctccgtgggggggggggggggggga

SEQ ID NO: 327042 - DNA, 1306 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacgacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327043 - DNA, 1088 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327044 - DNA, 1130 bp, Homo sapiens
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctccctccgcgctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 327045 - DNA, 1487 bp, Homo sapiens
agtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccagga

SEQ ID NO: 327046 - DNA, 2921 bp, Homo sapiens
agtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcaagactccgtctcaaaaaaaaagggctgataatgataaacagtgagcactccggtcctttttcttacgttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataa

SEQ ID NO: 327047 - DNA, 2894 bp, Homo sapiens
agtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcaagactccgtctcaaaaaaaaagggctgataatgataaacagtgagcactccggtcctttttcttacgttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaagcattgattgtagcacctgctgggtcctctaggtcag

SEQ ID NO: 327048 - DNA, 4128 bp, Homo sapiens
agtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactgtgagcggcagtggcggcggctggggggaacccggatgggaagaagggcgggggaggctgggaggcggggcagaggaaagaaagaaaggagagtgaggacccggatgctgaaccggattgtgtatgaattttccatcccctagctttaagcgaggagggagaggaagggttggccaagtggggcggaagggagcatctgagcgaggaggaagcagaaacctcaccgtttcttcccctccggactctgtgctagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttgtatgtctctggccattctcaaaccaggcccttccctttgaaaagtcgtttgcatgggatgttcacttcttagacgcaaggttgtgtgccctggtttcatcgtctaacgcgttagaaggcgctttcatttcttcatgggtgttgagcgccgaccactggggtggcctctgccttcgtagacctgcgcctggtgagacggacagatgctgaacaaaacgatgtgaaattaccgcagtggcagtgccccagaggagagttccacggtgataggagaatgagggaatttggcttctttagggagggaaaggaagggtttctgagcaagtgaggatcgagctgagagctgaagggctagcaggagttaactaaggaaagagaaaaggaaaagacattccagacaaaaagactaacttgtcagaaagccctgtggcggaagggagcttttccaatatgaagaactgagcctggagagatgggatgagggggagtgtcgaaccttttaggctttgtaaaggagttttggttttctcctaatagcaatgggatatcttccaaggaatctcaatcaaaagggagagatggctccgattggaatgtcatccctggctgaagagtagaggaagcgaaaaaaagaagagttaaagaggcaaatgcagggaacccgacgaggaggctattgccgtagtagttcacatggtgaaaagaatggagcgtttgtattaatgattatggattcactctttgaacaaatttctggcagctttttagttttgaaagtgagaagtttcagactctcactgagattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcaagactccgtctcaaaaaaaaagggctgataatgataaacagtgagcactccggtcctttttcttacgttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataa

SEQ ID NO: 327049 - DNA, 2940 bp, Homo sapiens
ccccctcccctacctctttcccggatggcctcttagacgaccttggattggttaaagttctttagaacccgcctatacactgttcctattggtccctggatacaaacaacgacgccattttcccaccagttctatggaaacagaaagttacgcctcaaggctttctgggaaataaagtccatactctggggccaacgcgcaaatcctcgtccgcgagaactgcaaggcccgcaatgccctgcgcctgcgtggaccgattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcaagactccgtctcaaaaaaaaagggctgataatgataaacagtgagcactccggtcctttttcttacgttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataa

SEQ ID NO: 327050 - DNA, 2828 bp, Homo sapiens
agtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactgtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcaagactccgtctcaaaaaaaaagggctgataatgataaacagtgagcactccggtcctttttcttacgttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataa

SEQ ID NO: 327051 - DNA, 1607 bp, Homo sapiens
agtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactgtgagcggcagtggcggcggctggggggaacccggatgggaagaagggcgggggaggctgggaggcggggcagaggaaagaaagaaaggagagtgaggacccggatgctgaaccggattgtgtatgaattttccatcccctagctttaagcgaggagggagaggaagggttggccaagtggggcggaagggagcatctgagcgaggaggaagcagaaacctcaccgtttcttcccctccggactctgtgctagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttgtatgtctctggccattctcaaaccaggcccttccctttgaaaagtcgtttgcatgggatgttcacttcttagacgcaaggttgtgtgccctggtttcatcgtctaacgcgttagaaggcgctttcatttcttcatgggtgttgagcgccgaccactggggtggcctctgccttcgtagacctgcgcctggtgagacggacagatgctgaacaaaacgatgtgaaattaccgcagtggcagtgccccagaggagagttccacggtgataggagaatgagggaatttggcttctttagggagggaaaggaagggtttctgagcaagtgaggatcgagctgagagctgaagggctagcaggagttaactaaggaaagagaaaaggaaaagacattccagacaaaaagactaacttgtcagaaagccctgtggcggaagggagcttttccaatatgaagaactgagcctggagagatgggatgagggggagtgtcgaaccttttaggctttgtaaaggagttttggttttctcctaatagcaatgggatatcttccaaggaatctcaatcaaaagggagagatggctccgattggaatgtcatccctggctgaagagtagaggaagcgaaaaaaagaagagttaaagaggcaaatgcagggaacccgacgaggaggctattgccgtagtagttcacatggtgaaaagaatggagcgtttgtattaatgattatggattcactctttgaacaaatttctggcagctttttagttttgaaagtgagaagtttcagactctcactgaggtattctgtagttttttcactctaaaaggaaactagtagagttcatgtaacacacactaatgcctctttacatttaactttagtatgtgatagctgaaatttccagctgtgataaattgggaaatcctttgatttaaaagaaaaacaaaggcgggtgagggtg

SEQ ID NO: 327052 - DNA, 465 bp, Homo sapiens
gcaaccaggcgccagcccccgaaccatcacacgccgactcggggctccctccggccccgccatccccgcaaacccaaccacctacacagctcggcagcttcccgtccccattgtcgagacccgacggagtttcccgtctacgacaatgacgccatttctgtcagagaagaaactcacaacaagcccggcgtccggcgcagggccggccgctctcccctagggcctcggcgcccggccgagcgaatccgcgcccccacgcgccgcgtccgagcgagaggccggccgggggccaccgaggggccaggagggcctgtgggccgcgggcaggaccggcccgccacagagcccctgcccacgtcccgttccgggctcagacccgacaagtgggagcgagatcaacatctggccccgccgcggggacaacgtgagggccgagggccccggaggcggaacggcccccaccct

SEQ ID NO: 327053 - DNA, 1481 bp, Homo sapiens
ggtattttacaacactgagaaagtagctccagcagcacccgagagggtcaggagaaacagcggaggaagctgggtaggccctgagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccagga

SEQ ID NO: 327054 - DNA, 3108 bp, Homo sapiens
gcaaccaggcgccagcccccgaaccatcacacgccgactcggggctccctccggccccgccatccccgcaaacccaaccacctacacagctcggcagcttcccgtccccattgtcgagacccgacggagtttcccgtctacgacaatgacgccatttctgtcagagaagaaactcacaacaagcccggcgtccggcgcagggccggccgctctcccctagggcctcggcgcccggccgagcgaatccgcgcccccacgcgccgcgtccgagcgagaggccggccgggggccaccgaggggccaggagggcctgtgggccgcgggcaggaccggcccgccacagagcccctgcccacgtcccgttccgggctcagacccgacaagtgggagcgagatcaacatctggccccgccgcggggacaacattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcaagactccgtctcaaaaaaaaagggctgataatgataaacagtgagcactccggtcctttttcttacgttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataa

SEQ ID NO: 327055 - DNA, 2814 bp, Homo sapiens
agtagggaggcggcaacgacgcctgcgcagtgtgaccgggatggcgcattttcttgcaccaactaatgcggtgtcgctggcggctgaggagggcggagagttctgtggtgaaatagtgggaaggattcatattagctttgaagtttaaatccaatggagaagactcaagaaacagtccaaagaattcttctagaaccctataaatacttacttcagttaccaggtaaacaagtgagaaccaaactttcacaggcatttaatcattggctgaaagttccagaggacaagctacagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcaagactccgtctcaaaaaaaaagggctgataatgataaacagtgagcactccggtcctttttcttacgttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataa

SEQ ID NO: 327056 - DNA, 9931 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctcgttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgataagaaggcagtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcagttcaaaagaaatagaagactttcagtcaaccgagtctgtcagtagccagcagatgaacctcagtattggtgatgacagcactggtagctggtccaatttaagttttgaagatgaacaccaagatgaaagcagcagttttcatcatctaagtgaaagtaatggtaacagcagtagctggagcagtcttggtttagaaggagatttgtatgaggacaatttatcctttccaacatcagacagtgatggaccagatgataaagatgaagagcatgaggacgaagtagaaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctactttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttctttcctgtttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggtgtgtgtgtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttttttgtttgtttgttcgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctgg

SEQ ID NO: 327057 - DNA, 342 bp, Homo sapiens
tcccccgggaaaaaccccggacaaaaaaaaggggttccggggggggggtttttcccccgggaaaaaccctggccaaaaaatcggattttcgggggggggtttttccccccgggaacacctatggccaaaatttagaatttggggccgggggccccccgggaggcccaaaaaaaaaaaaaaaaaaagactgtgacaatttgaaaacaccttgccagtttcattataagcaggaagttcagtggagggcaacaactaaaaaacacaccaatttcagattttcaaaagtgtttaggaggattatataattatttgatcagaaaagaactgggtggatagtctgtg

SEQ ID NO: 327058 - DNA, 9847 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctcgttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgataagaaggcagtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcagttcaaaagaaatagaagactttcagtcaaccgagtctgtcagtagccagcagatgaacctcagtattggtgatgacagcactggtagctggtccaatttaagttttgaagatgaacaccaagatgaaagcagcagttttcatcatctaagtgaaagtgatggaccagatgataaagatgaagagcatgaggacgaagtagaaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctactttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttctttcctgtttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggtgtgtgtgtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttttttgtttgtttgttcgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctgg

SEQ ID NO: 327059 - DNA, 6122 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctgtggaccatcagttgaacttagcccctggaaatggcaaactaggtgtgggagggaaggcaactcttggaaaagggaatgaggtagcataaggaaaggaaatggcttttcacctgatagaacacttcatctcgaagagttttgttcgatgcttggattaacctggaaatattaatatttttgtaaagtatattttgtcatagtttattatggtgctatataaaccaccaatatttcttaaaatctaggtccaaaaagacagtgtttaaaactggtagaagcaagtgggggcaatgtcacaaatcatgatttggcccttttctataactttatctagaaaaggatactaacatttagtttcttctctcattttgagaaacacaggcttctatgatttcagtggggttgacagtgttgcctaggaaatcctggcgttaaaatgggagattgaggtgtgggtagaggctttaagcattaagaggacttgtagtcagttgaacaactctgtgctgaatattatctaatttgatgagaaaaaggagtcgtcttaccggtttctgtccttggttctgtcctccttagcattatttattaatgatgtggaatactcatttgtggatgattcaacacaggctgaaaaaagaatctcattaacagaacaaaggttaaaaagaccaaatcaagctgaggttaaaataattatgtttaacatggataaatgcatttaggctcagaaaattaatgattaatatttgaacttaagtggggagcaaacctggcttgatggcattttgtcagaaaaagacctgtgtttccattgaccaaagttgtaatgtgacttaatgtaatgctgcgtggcattaaggttctggcacagagaaaaagcggggctcatccaggattggtggtgtgctcgttgcatatacagtgtccagggtctcacctccagagatgaagatttatgaagtcagtgaagggtcctgagaatctgcatgcttgataagcatcacagatgatttcagtgcaggtgattcagagacctcacttgaaaatatattgatttacaagatatgttgcatctgttgatgacaattgatatctatactgttcttttctgctacagagatcaaggtaggagataaagacttcaggcgatttgggctgggcgcggtgattcacgcctgtaatcccagaactctgggaagccaatgggggtgggggtggatcacttgaggtcaggagttcaagaccagcctgggcaacatggtgaaaccccgtctctaccaaaaatacaaaaattagccaggcgtggtggcaggcacctgtaatcccagctacttgggaggctaaggcaggagaattgcttgaacctgggaggcagagattgcagtgagctgagattgtgccactgtactccatcctgggcgacagagacagactccgtcaaaaaaaaaaaaaaaagactgtgacaatttgaaaacaccttgccagtttcattataagcaggaagttcagtggagggcaacaactaaaaaacacaccaatttcagattttcaaaagtgtttaggaggattatataattatttgatcagaaaagaactgggtggatagtctgtg

SEQ ID NO: 327060 - DNA, 1789 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaggtttccatgcttaaaagttacagttttattctaccatgttaatactgtaatattgataggtatagggccggct

SEQ ID NO: 327061 - DNA, 1046 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtttaacatactactttctaaaccctttcctaataatgcacagcatattttcatgcatctttgtaggactctatgatctatttttaaaatgcctaaaatctctatttgttgttacatgtatcagaagtacctgttttgtgggcgggagaggggaaaaaaaagaagtacctgttttaaatactggctaaaataattttcttaattgacaatgaactcaaacaaatgagcacatttattttatgcagagtactaattggatatatagcattacattagatgatgcctactatattcagcaactgatactttaatatgaatttttctactctgaaacatagaacaaatgcatgattcttatgttgattttttgggttattttcttgactgtttaaattcagtgctttgattaaaaatgaaaaagtagtgataaatttatctttgaaattaagatacttactctattacttgaggataagataatataccttgctcacctatttctctgctacatccagtgtttcaaatctttgtttgaatttattattataaaaagagtaagatccttttctataatatatccatacttcatcatcacatttgttaccaaatacgagatgtattaggtcgttgcagctcacaactgatgaatatttgaagttaaaacattttattttgaaataagcgttctaataaaatcgtggtt

SEQ ID NO: 327062 - DNA, 9776 bp, Homo sapiens
ggtttaagaactgcgttttggagcccaatctttggtgaaaaatatttttgggtcatctttgaaaaaaatccttttcaagcagacagcattttaatgctttgtctgttttttcctgtttgtcagctctgtcaccagcctgaaagatttaaaaattcaaattaatggaggtttatttgttctttactcaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctcgttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgataagaaggcagtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcagttcaaaagaaatagaagactttcagtcaaccgagtctgtcagtagccagcagatgaacctcagtattggtgatgacagcactggtagctggtccaatttaagttttgaagatgaacaccaagatgaaagcagcagttttcatcatctaagtgaaagtaatggtaacagcagtagctggagcagtcttggtttagaaggagatttgtatgaggacaatttatcctttccaacatcagacagtgatggaccagatgataaagatgaagagcatgaggacgaagtagaaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctactttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttctttcctgtttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggtgtgtgtgtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttttttgtttgtttgttcgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctgg

SEQ ID NO: 327063 - DNA, 10272 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctcgttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgataagaaggcagtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcagttcaaaagaaatagaagactttcagtcaaccgagtctgtcagtagccagcagatgaacctcagtattggtgatgacagcactggtagctggtccaatttaagttttgaagatgaacaccaagatgaaagcagcagttttcatcatctaagtgaaagtgatggaccagatgataaagatgaagagcatgaggacgaagtagaaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctactttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttctttcctgtttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggtgtgtgtgtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttttttgtttgtttgttcgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctggaaaaaaaaacaaaaacaaaaaaaaaaaaaaaaaaaaataagaagggagacaggggaaggaggagagagaaaagagagaagagaaagaagggaaaacaagaaagaacgcgggaggcgagaaaaaaaggagggggcgtccagaacatcaaaatgaaagcagaatgttgcgaaacacaaacaagaacgaaggggggagagagacacagggaacgagattaaaaacgagcggcggtgccgagaaagtcacacgacaagcgaaaagagcaagataggagacactaagcacagcagcaggacaaccagcgaaggacgacgacaaaaaaagaagggacaacaaccagggaggaagaaggaaaaacacggagacaccgacactcagcccgccgcccgaacaggaaagaagagtgcaactcgagagaggcaaat

SEQ ID NO: 327064 - DNA, 5939 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctgtggaccatcagttgaacttagcccctggaaatggcaaactaggtgtgggagggaaggcaactcttggaaaagggaatgaggtagcataaggaaaggaaatggcttttcacctgatagaacacttcatctcgaagagttttgttcgatgcttggattaacctggaaatattaatatttttgtaaagtatattttgtcatagtttattatggtgctatataaaccaccaatatttcttaaaatctaggtccaaaaagacagtgtttaaaactggtagaagcaagtgggggcaatgtcacaaatcatgatttggcccttttctataactttatctagaaaaggatactaacatttagtttcttctctcattttgagaaacacaggcttctatgatttcagtggggttgacagtgttgcctaggaaatcctggcgttaaaatgggagattgaggtgtgggtagaggctttaagcattaagaggacttgtagtcagttgaacaactctgtgctgaatattatctaatttgatgagaaaaaggagtcgtcttaccggtttctgtccttggttctgtcctccttagcattatttattaatgatgtggaatactcatttgtggatgattcaacacaggctgaaaaaagaatctcattaacagaacaaaggttaaaaagaccaaatcaagctgaggttaaaataattatgtttaacatggataaatgcatttaggctcagaaaattaatgattaatatttgaacttaagtggggagcaaacctggcttgatggcattttgtcagaaaaagacctgtgtttccattgaccaaagttgtaatgtgacttaatgtaatgctgcgtggcattaaggttctggcacagagaaaaagcggggctcatccaggattggtggtgtgctcgttgcatatacagtgtccagggtctcacctccagagatgaagatttatgaagtcagtgaagggtcctgagaatctgcatgcttgataagcatcacagatgatttcagtgcaggtgattcagagacctcacttgaaaatatattgatttacaagatatgttgcatctgttgatgacaattgatatctatactgttcttttctgctacagagatcaaggtaggagataaagacttcagctacttgggaggctaaggcaggagaattgcttgaacctgggaggcagagattgcagtgagctgagattgtgccactgtactccatcctgggcgacagagacagactccgtcaaaaaaaaaaaaaaaagactgtgacaatttgaaaacaccttgccagtttcattataagcaggaagttcagtggagggcaacaactaaaaaacacaccaatttcagattttcaaaagtgtttaggaggattatataattatttgatcagaaaagaactgggtggatagtctgtg

SEQ ID NO: 327065 - DNA, 737 bp, Homo sapiens
aaaaacatgtgagctccttgagggtaatccctctctccctggtagccctagtactgccttcaggcagatatccacaaaagcaccttgcacagaaacatctttgagctattttaagaggcagcattattttactgacaaatgttcagaattgagctctctgacttgcccccagcccaacctctatggattgaccattctcctcagagagactgtgtatgcctgtgcaggcacacatgttgaggggaagacaggaagacctaccctcccccaggccctggcttctcttcagacagtgccattcacactgagcctcacaggcaagtactgcctggtgtaacttggggagtgatggggcctgctgaccagaatcactcctccaaaagcttcacacacaagcctgagtttccagtcatcaccagcagcaccttcagtctttgagagccttcttaatgaacacacatatttacctggatcaagacctgtgttatctggcaaggttgcccatttaaaatgagtgactggaaagttcgttatctggtcaaccctctactgcccccctattgtcacccctttgggattagaatcctgaaagaatgatgagaagaaaggctacatatggagagacctgagaaaccccgaatctttcttgagaggaggaaatcagacacctgcacagtccagcagcctgatcccaggagccagggagcagggagcagaggagagttccagggaccaga

SEQ ID NO: 327066 - DNA, 584 bp, Homo sapiens
cctaaggaaaaaccttagaggtcttctcggcgagtgggttccccaagcgtactttgacctcagagcctttagctccactgaaatcaaatgcagaatcctcgtatgggacacagagagaaaaacagagctgcagtgtttgaaaggactgtcccccacccccgccacttctgccctgcctccctctcctctgctgcgccgctgcggggctcggtcgaatcccccaggggtgctcagagcccttatctgaccctggccctcgtctgccacagaaaccttcacaatccagcttttgctcacacatctgtttctagaagctacggttgctgaaaacaatctttcctttgccaggagaaaagactttctgtaacttcccccgttcctcctagaactgtcttttgcctttctcagacggccacacacacttgaagctttcatgcttccactggtccttgcttctctgaactgcgtgttccaccctctcttccgagagagttcacacaggtcacacgacatcacctccggtcccaactgccctggtcactgtccccagatgcgcttagtccacagagtcccctgctgaagcc

SEQ ID NO: 327067 - DNA, 1739 bp, Homo sapiens
ccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacaggcttcatccagtgaatactagagggatcgaacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 327068 - DNA, 1825 bp, Homo sapiens
ccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacaggttgatgtcatatttttagtcttgagaaacagcatcatgccaaggaaagagcttgagctttggagtaatgcggccctgagattgaattctggctctgccacttattagctctgttctagattgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 327069 - DNA, 1687 bp, Homo sapiens
ccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacaggcttcatccagtgaatactagagggatcgaacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 327070 - DNA, 1671 bp, Homo sapiens
ccgcggtcccacggcgcctggttgcccccagccccctccctcctcccaccttcactgtgtcccacccttcctagctttgtgcccggggtgctgagcccgtcaccgaggagctgccgctcgctgccccgggcaggggcacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 327071 - DNA, 1705 bp, Homo sapiens
ccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 327072 - DNA, 1681 bp, Homo sapiens
ccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacaggcttcatccagtgaatactagagggatcgaacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 327073 - DNA, 1988 bp, Homo sapiens
gaacatcccgtctccagaggtcaagagattattagcccaaagtgtagctacttgcagatagagcaggggcttttgtcctctgcttcccaactcttgccctatctttctattgtaccactccaaatatttcttatcacaatgttgctgttagtagtaacactagtaaatctgagtatttataagctcataaagcttgttacagccttaagcaaaaagcttggggccaagggcgttttaaaaaatgcacactttatgaggtgcaactgcggagaaatgaggacgcgttcttaagctttggtattcacatggtggtggtgctggtagaggctgttacatttcttccagtgaagctgttcttgcagccgccttggaattcacttcagggccagtttatgagccaccccaagtaatctgcttggagtctgagcatcataccttgtatttgaccaaaaatggtattcctgagctcagtgccacctgattcactgcacttggaaccagatgatgttgggctctttccagaagtcaaatccttcctgggaggatgaagatctgccagctctgaggattctggctgggaagaaaaagagcctcaagctttgaaggccattcccatggtagacagagctgatgtgaaaagtggccatcctgttgccccaggcacatgaccttctgaagtgaccaggctgaaagggaagcaatactcgtgtaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 327074 - DNA, 1334 bp, Homo sapiens
ccccgactagcccgacagggaactacttccgggggagcggcgcggcggcgcgggagaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 327075 - DNA, 1340 bp, Homo sapiens
ccttccctccagccctgggtaacctcaattctactttctgtctctgaattggcctattccagaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 327076 - DNA, 1188 bp, Homo sapiens
  misc_feature (9)..(9): n is a, c, g, or t
cccacgcgntcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 327077 - DNA, 1259 bp, Homo sapiens
ccccgactagcccgacagggaactacttccgggggagcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggagttccatgtagaggcctgattccattccagtcaggttattgggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 327078 - DNA, 1339 bp, Homo sapiens
  misc_feature (1280)..(1280): n is a, c, g, or t
ccccgactagcccgacagggaactacttccgggggagcggcgcggcggcgcgggagaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccgntgtaggaaggagtttgccattaagccggcgaaggtaattgtgtgaataatctaacgcct

SEQ ID NO: 327079 - DNA, 1145 bp, Homo sapiens
ccccgactagcccgacagggaactacttccgggggagcggcgcggcggcgcgggagaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctggaagcggccagaaatgctgggtggagcagagaagcggcgggtagcgtgctgttctgtcatcgggcgggttggtcgagggtgttttctggccattctggcctgaggggtggattgaccctttaccttttgttg

SEQ ID NO: 327080 - DNA, 1024 bp, Homo sapiens
ccccgactagcccgacagggaactacttccgggggagcggcgcggcggcgcgggagaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtcctctgagtgccctcctggggttacctacttcgggtccttgctatgtgcaaagacactctccattttgggctacggatccgcggcaggccttgtgcggtggtaaagcacgccctgtgttggcacagccggcaccgggccaacgacacgcacaactgcggacacacggcggcgctcgcacggaggggggtgacccgggggatacagggctctcgggggtcgtag

SEQ ID NO: 327081 - DNA, 1389 bp, Homo sapiens
gaacatcccgtctccagaggtcaagagattattagcccaaagtgtagctacttgcagatagagcaggggcttttgtcctctgcttcccaactcttgccctatctttctattgtaccactccaaatatttcttatcacaatgttgctgttagtagtaacactagtaaatctgagtatttataagctcataaagcttgttacagccttaagcaaaaagcttggggccaagggcgttttaaaaaatgcacactttatgaggtgcaactgcggagaaatgaggacgcgttcttaagctttggtattcacatggtggtggtgctggtagaggctgttacatttcttccagtgaagctgttcttgcagccgccttggaattcacttcagggccagtttatgagccaccccaagtaatctgcttggagtctgagcatcataccttgtatttgaccaaaaatggtattcctgagctcagtgccacctgattcactgcacttggaaccagatgatgttgggctctttccagaagtcaaatccttcctgggaggatgaagatctgccagctctgaggattctggctgggaagaaaaagagcctcaagctttgaaggccattcccatggtagacagagctgatgtgaaaagtggccatcctgttgccccaggcacatgaccttctgaagtgaccaggctgaaagggaagcaatactcgtgtaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggagttccatgtagaggcctgattccattccagtcaggttattgggtacgaatacctcagagctggtgctatgtactccctactgtgtggcatcaacaagcaggtggtgtctggctgctgcacatttagagattcttggattgatcggtgggtttaggtggtatcagctgatccctccattataaaaatccggtcagtctttcacctaagcggttttagcatccattgatggtcgttgcttagatccattatttccttctgcatctgttagctggaattctttaacaaagaccttttccttatcacttgtatgattactctgaattgctcttcataatgaaaagcaggaaaaatg

SEQ ID NO: 327082 - DNA, 1466 bp, Homo sapiens
ccccgactagcccgacagggaactacttccgggggagcggcgcggcggcgcgggagaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaaaaaaagcaaatataaacaaacaatacacaaaaaaaaaaggggggccaaaaaaatcccggggggccaataggtgtcacactttctgtaaaggccctaagggggataagagagagcgggaaaagagcggggaag

SEQ ID NO: 327083 - DNA, 897 bp, Homo sapiens
ccccgactagcccgacagggaactacttccgggggagcggcgcggcggcgcgggagaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtgtcggtaatcgcgtggacgaagtctcttgcagaatcatgaatggacgataatagctggcatacaac

SEQ ID NO: 327084 - DNA, 1215 bp, Homo sapiens
ccccgactagcccgacagggaactacttccgggggagcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagaatcacattttcttgcttagtcatgtgtccctccttgagttgccccctccttgtgggtttacactacattttggagtcattgtctaatgctgacaagcacaccctctcccattatttgtgcactacagatctcctgctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccggggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 327085 - DNA, 468 bp, Homo sapiens
atttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagctttatttgtggaccatctgatttaattattgaggattaaaaacctaaacctttgctcattctaaactcaagcttttaagcctcacagaatttacaggggtttgctttttgtttgtttgttttttcattttttactgtgcttattaaactcttggaattagttattaaagggagtaaattctcatcttgggaattttgaaaatctatgg

SEQ ID NO: 327086 - DNA, 307 bp, Homo sapiens
atttaacaaatggaaaggaatagaacactgatattttacagaattaaaccccttcattgtaagggctttgtttacatattaagtgtcaagtatttattcaggggatcttatttcattgtattttatctgttatctaggttgtccatttaccggttggacactgatactctgtcaaattcctttcaaaaatgactctttagtctgctgaaatttagcactagtactttagtgttctgatcctggaaaattcaaggtgaagggtggtatagggtgggatagggtggtatggtggtatggtggtatcagg

SEQ ID NO: 327087 - DNA, 1163 bp, Homo sapiens
aagactcaagtctggggacctcctggtcactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctca

SEQ ID NO: 327088 - DNA, 643 bp, Homo sapiens
aagactcaagtctggggacctcctggtcactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagactgcctttgtgaccttgggaaagtcagtgagccacagtatgtctgctgaatttaagtagaaatggaccatgttttggaagaacccttgacttctagaggaaaagctggaggatgagctggcagccatgcagaagaagctgaaagggacagaggatgagctggacaagtattctgaagctttgaaggatgcccaggagaagctggaactggcagagaagaaggctgctgatctttcccaagtcagaaagtaccctcagagatatgcataagaacaagaaacaggagagggaaggttgtggccaggagcaagcaagaagaaaggtttctttcctcaaagctagagtcagcaaactaccacctgtgggttaaatcttgcaacagcctggttttgtaaataaagttttatcggaacaca

SEQ ID NO: 327089 - DNA, 466 bp, Homo sapiens
  misc_feature (83)..(83): n is a, c, g, or t
tgtgaagaggctggagcaagggatataccttggggaaggggattgggtccagatgaaaagggctttgagtgtggggcagcagnaggaggacgtcctccttgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgggaggaggacgggtccgagcaagc

SEQ ID NO: 327090 - DNA, 1353 bp, Homo sapiens
cacagcatcaaggatgtgcacgcccggctgcaagccctggagcaggaggagcaggaggtgagaggaggctgcaacgccgagcggaggaggcaggaaccggagcgcgagcagtagctgggtgggcaccatggctgggatcaccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccaacgtgaggctgagctgctcaccatgctgcagcaccagcacatcgtgcgcttcttcggcgtctgcaccgagggccgccccctgctcatggtcttcgagtatatgcggcacggggacctcaaccgcttcctccgatcccatggacccgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagcccagcaacgccacagcatcaaggatgtgcacgcccggctgcaagccctggcctaggcacctcctgtctacctggatgtcctgggctagggggccggcccaggggctgggagtggttagccggaatactggggcctgccctcagcatcccccatagctcccagcagccccagggtgatctcgaagtatctaattcgccctcagcatgtgggaagggacaggtgggggctgggagtagaggatgttcctgcttctctaggcaaggtcccgtcgtagcaattatatttattatgggaattc

SEQ ID NO: 327091 - DNA, 607 bp, Homo sapiens
gttgagtgctgtctcatctcttcatggaatgctccattcttttccacttacttggcatctttcatctcttctttcctagttgcttcactgcctctccacagggtctccttcctttgggtgatttgggggactgtttgggttgggcatttgttcccacctccaccccaggtagcagttatgacttgttcctggtagtggatttctctcaagtgctttattagtattcaaacatttttgagcccaggaaggtctagctcctgacacgttctatggtagagggaggagggttgatgcttgctcaggttacttgggaacatctcttccccagtatgccttccaactctctctacatataggttcaattcacgtctatgtgtctctctccctttttttattctcttccttttcccttttcctctcctgtggtatttaaaatattcacaacctcaagtctcttgaggctcaggcggagaaggtaggggctggtttgtgaaagtgacaggctttggggcctgggcccagccctgcccttgatgaaagactggagacacgcattccatatataatccagtgaggcgtgtcctcttcctacctccttaccatgtat

SEQ ID NO: 327092 - DNA, 2142 bp, Homo sapiens
acccccacacacatacccaaacaacacaaattgcatgatgaggccgtgcgttatatggacgagggcacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327093 - DNA, 2320 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaaaaaaaaagaaaaaagaaaaaaaaaagtttgcccaaagtgggcggatacaattgtgaccggcggaaattagtatataatcgacgggaatcggaccggcctgaagggccagtttcctaaggggccgataaagctgggaacagggaagcgttcggaggaatgtaccgcgcatt

SEQ ID NO: 327094 - DNA, 2569 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaaaaaaaaaacatactaaacaaaaagaacaaaataaaacaagtaacaggcaaaaaagaaacaaggggcgggcgacacacaatatcgccgagggggcgcaccatcagacacgcccccttgtctgcaaaaggagccacacaaaacgggcagcacatcacacgcacgaccacggcaccatccaaaccacgcgagcagagaagaaaaagcggcgcacacggacgatctcgagaggcagagagaacacacacagcggagcgaggggaccaacaatcgggcacgagacacacaccacgagaaaaactaggaggaccccgagggacaagaaataaaaaactgagcgtcgccaccagggtagtagcaaacacagcctaatgaccgcgtgcacacaacatccccgaggacgtgaccccgcaaactcttcc

SEQ ID NO: 327095 - DNA, 2181 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaattgtttgttgtctgttggttgtttgttgtttt

SEQ ID NO: 327096 - DNA, 3167 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaaaaaaaaaaaaaaaaaaaaaaaaaaaaaaaaaaaaaaaaaaaaaaaaactcgagggggggcccggtaccaggtaatctactgcctgcgctgtctggtgggccgcgacatcccactcaaccagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccaggtgcgggggcggggtgggcgcagctcgggggcggactgggtgggcaggctggagtaggagcgggagggcgaggtggggacgccctgccccagcccagcgcagcgaccaggtgccctcaccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccggtacccggtcatcctgcgccgcttcgagctgcggcggggctcggggggcagaggccgcttccgaggcggcgacggcgtcacccgcgagctgctctttcgtgaggaggcgctgctgtcagtgctgaccgagcgccgcgccttccggccatacgggctccacgggggcgagcctggcgcccgcggcctaaacctgctgatccgcaaaaacggccggacggtgaatctgggcggcaagacgtcggtgaccgtgtaccccggggatgtgttctgtctccacacgcccggcggcggtggctatggggacccggaggaccccgccccaccgccggggtcgcccccgcaagcactggcctttcccgagcacggcagcgtctatgagtatcgccgggcccagaaggccgtgtgaggatcccgcaataaaaatgccttaagtctcccggttctggggacgcagctacggcgcctt

SEQ ID NO: 327097 - DNA, 2350 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaaaacaaaacgaaaaaaaatatataaaaaagaaaaaaaagaaaaaagaaaaaaaaaagtttgcccaaagtgggcggatacaattgtgaccggcggaaattagtatataatcgacgggaatcggaccggcctgaagggccagtttcctaaggggccgataaagctgggaacagggaagcgttcggaggaatgtaccgcgcatt

SEQ ID NO: 327098 - DNA, 1972 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacgtactagctaaaaccagaaaggtgattccaggaggagtgagacagagaacaaccaggaaccaaaccaattgtgctgtttcaacgttctcagctttacgatatcttgggaatacgggtatctctataggtgatcttccccatccagaagtca

SEQ ID NO: 327099 - DNA, 1683 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctcctatgtcgttttcgggatcctctagat

SEQ ID NO: 327100 - DNA, 2115 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgaccttgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327101 - DNA, 2228 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327102 - DNA, 2015 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327103 - DNA, 1471 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaatacaaaaaataaaaacatgt

SEQ ID NO: 327104 - DNA, 1950 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgaggaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327105 - DNA, 2149 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327106 - DNA, 2073 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327107 - DNA, 1696 bp, Homo sapiens
  misc_feature (7)..(7): n is a, c, g, or t
ggagtanggatatcgtcgaccaggcgctcgagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327108 - DNA, 2228 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327109 - DNA, 1557 bp, Homo sapiens
gagtgctgagattaggctggctgagagagctgaaagcaccacaacctaagctctgagctagcgggatactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327110 - DNA, 1262 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgggaggaggacgggtccgagcaagc

SEQ ID NO: 327111 - DNA, 1412 bp, Homo sapiens
caccggcccggagctggcaccactcccgcgacgcaagcgacagacagaacactcataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327112 - DNA, 1054 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctcctttcgcagtctctaatcgaattcccgcgtgccgcatgggggccg

SEQ ID NO: 327113 - DNA, 1052 bp, Homo sapiens
  misc_feature (1038)..(1038): n is a, c, g, or t
  misc_feature (1041)..(1041): n is a, c, g, or t
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttgtgcctctgcctccttgtgcctctgnggntcctctagtca

SEQ ID NO: 327114 - DNA, 2001 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327115 - DNA, 1693 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagagatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327116 - DNA, 1211 bp, Homo sapiens
  misc_feature (73)..(73): n is a, c, g, or t
cttgtaacatgaggggacttggactttctttagaggctgggaaaagcgccttggcatatatctccattttacncccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327117 - DNA, 1121 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctatctttaactggaaggctgctttctcctttcaccaccccctccttcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327118 - DNA, 1511 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgcccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327119 - DNA, 1432 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgcccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327120 - DNA, 1069 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctca

SEQ ID NO: 327121 - DNA, 2196 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccaacgtgaggctgagctgctcaccatgctgcagcaccagcacatcgtgcgcttcttcggcgtctgcaccgagggccgccccctgctcatggtcttcgagtatatgcggcacggggacctcaaccgcttcctccgatcccatggacccgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagcccagcaacgccacagcatcaaggatgtgcacgcccggctgcaagccctggcctaggcacctcctgtctacctggatgtcctgggctagggggccggcccaggggctgggagtggttagccggaatactggggcctgccctcagcatcccccatagctcccagcagccccagggtgatctcgaagtatctaattcgccctcagcatgtgggaagggacaggtgggggctgggagtagaggatgttcctgcttctctaggcaaggtcccgtcgtagcaattatatttattatgggaattc

SEQ ID NO: 327122 - DNA, 1227 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttg

SEQ ID NO: 327123 - DNA, 1410 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctcatgccaccctgcatttgtgtcattgacaaagctgttgctgtccctaagaaggagccttgggggtgtgatgtggggaagagctattgtaggctccccctcctctgacttatgtaatcaaagccacttttgtgtgtgtctattttttcttgacatttaaactcagctgatctgattctaccagagtgatggatttagtacaggttactcaggatagtaattttagttatactcctcaagctgaacaagattaaattccttatttccaggttcttaaatcatcctgcctgcagtgtttccattctctcttcaggtattcctcctttggtgtggtgtcattgagaa

SEQ ID NO: 327124 - DNA, 1527 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttgacaagttgttgtaactgcttcatcggcaggcccaggaatgggtccttctgactgggtggaaaaaagggaagtgaaagaaaagttgtgggatatgaatatgggtctgtgttgccatcaccttctctgagttgaagatttgagtattttcctcacctctttagagcagtcagagtggtttgcttgctagacagattagattctccttaatgttcagctgctga

SEQ ID NO: 327125 - DNA, 1306 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttg

SEQ ID NO: 327126 - DNA, 1448 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttgacaagttgttgtaactgcttcatcggcaggcccaggaatgggtccttctgactgggtggaaaaaagggaagtgaaagaaaagttgtgggatatgaatatgggtctgtgttgccatcaccttctctgagttgaagatttgagtattttcctcacctctttagagcagtcagagtggtttgcttgctagacagattagattctccttaatgttcagctgctga

SEQ ID NO: 327127 - DNA, 1176 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaaggtactaaccattaagcccacagcaagttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327128 - DNA, 1079 bp, Homo sapiens
  misc_feature (845)..(845): n is a, c, g, or t
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataactgaattggcaagaagggcctctggtacaaggtggggacagactgtttgnctgaattgactcggtaaacggcccaagatcaaacccgtgtggatggactctcctctggccagattcgcgctggaggccagttgggtgaactggcctaaagagaggggggactaccacgggaaggggagcgcctttcacaagccctctttccacgggtatacgaccaaggtgtagcctcccggaacccacgggagacgagaccagagacgacacagagagagcagcgcgattatc

SEQ ID NO: 327129 - DNA, 879 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagtgtaccgccggaagcaccaggagctgcaagccatgcagatggagctgcagagccctgagtacaagctgagcaagctccgcacctcgac

SEQ ID NO: 327130 - DNA, 776 bp, Homo sapiens
  misc_feature (29)..(29): n is a, c, g, or t
  misc_feature (36)..(36): n is a, c, g, or t
  misc_feature (66)..(66): n is a, c, g, or t
gggatgtacgatacatttcccagaacagntagccanattcgattcagtcggaccgcggaaacgatntgcacaccaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327131 - DNA, 962 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327132 - DNA, 1069 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctca

SEQ ID NO: 327133 - DNA, 807 bp, Homo sapiens
  misc_feature (748)..(748): n is a, c, g, or t
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagaatcggtgccgattcttatagaaacgcctcttgcattcatcactgatgtgntcagcaaagacagtcttgaaggtccggagcctcgaggggtttccacgtagcccacagca

SEQ ID NO: 327134 - DNA, 1410 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctcatgccaccctgcatttgtgtcattgacaaagctgttgctgtccctaagaaggagccttgggggtgtgatgtggggaagagctattgtaggctccccctcctctgacttatgtaatcaaagccacttttgtgtgtgtctattttttcttgacatttaaactcagctgatctgattctaccagagtgatggatttagtacaggttactcaggatagtaattttagttatactcctcaagctgaacaagattaaattccttatttccaggttcttaaatcatcctgcctgcagtgtttccattctctcttcaggtattcctcctttggtgtggtgtcattgagaa

SEQ ID NO: 327135 - DNA, 1448 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttgacaagttgttgtaactgcttcatcggcaggcccaggaatgggtccttctgactgggtggaaaaaagggaagtgaaagaaaagttgtgggatatgaatatgggtctgtgttgccatcaccttctctgagttgaagatttgagtattttcctcacctctttagagcagtcagagtggtttgcttgctagacagattagattctccttaatgttcagctgctga

SEQ ID NO: 327136 - DNA, 1375 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatggtggatccaaagtaactggatacatcgttgaatataaagaagaaggaaaagaagaatgggaaaagggtaacgataacgaagtgagaggaacaaagcttgttgtgacaggattaaaggaaggagcattctacaaatttagagttagagcagtcaacattgtggcattggagaacctggagaggtcacagatgtcattgaaatgaaggacagactgtgtcacctgaccttcagttagattgccagtgttcagaacatagaatctgtttgtccatgcctggaggggtgatcccgaatcatgtgctaatgtgtctggaaagcctcctccaaaccgtccccctggaccatggaatgaaagaccttaactccaaagaagcaccattgagacccaagcattagtcattccaggcattcaagaaattggcagaggaagcatcaggggtcaatctcttcttgccaaaaatgtaagccggggaaagaacgaagaccactttgtgtctcgtttagatgtccacgcgcacgggaacctctctgtctcacactaacacggtcctcgacggcatgtttcccaaaatgagcgccac

SEQ ID NO: 327137 - DNA, 785 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327138 - DNA, 1063 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcgtgagtatctagctccccaaatcttgtcattaccaatttatcccttcccctttggcttgggcactaatatgaataaattagcattccttcaaccttgttaaacagggcctagggaatgggagtcatctatagtgcttttttaggcccaagaatggttttaggcttccttattctcctgactagtgacaagtgacaaaagaggctttcttattttttgttggtagggtttacaaattgagagcaaataaggactaatacatggtgaacagttaattggaagatcctactgggtccttccacctggggtggaagacatcaaagtggctatcctgatttaagatctagtgtctggctgggtgtggtggctcaaacctgtagtcccagctacttagtatgccaaggcaggaaggttgcttgaacccaggagttggaggccagcctgggcgtcatagggagaccctgtccctaaaacaaataaatt

SEQ ID NO: 327139 - DNA, 464 bp, Homo sapiens
  misc_feature (83)..(83): n is a, c, g, or t
tgtgaagaggctggagcaagggatataccttggggaaggggattgggtccagatgaaaagggctttgagtgtggggcagcagnaggaggacgtcctccttgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgggaggaggacggggatcctcta

SEQ ID NO: 327140 - DNA, 509 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggtacggagatggtgaggctcatgagggaggggcaggcgctggagtatccggcaagcggaataaggtcccttttgccgtggagcacggtcctctgaaggccggcgggctcggagatgaagttgggatctcggaggatgggtggggctcagcaccagtaggacaccaagcggacgagggggaaacagtgctcgggcgagcaggcttgacctttgaagaaattgagccttacggggtttggggtgtggctttc

SEQ ID NO: 327141 - DNA, 223 bp, Homo sapiens
aaaatactcattcaacccctctcccctttgttagctttcccaagtcagaaagtaccctcagagatatgcataagaacaagaaacaggagagggaaggttgtggccaggagcaagcaagaagaaaggtttctttcctcaaagctagagtcagcaaactaccacctgtgggttaaatcttgcaacagcctggttttgtaaataaagttttatcggaacacagtca

SEQ ID NO: 327142 - DNA, 378 bp, Homo sapiens
gagtatcaagaaaggaagttggtcataggagagagtagatctgaaaatgtccagtcatggttgccagagtagatattttcctaactgtggtattagacccacagtcacactttcctaatttctaatgattccctctcttcatctgcttctgaaacccttcactctgtcccctcattcctccctgtggttcctgtgcctgtccagatgagctctatgcccagaaactgaagtacaaggccattagcgaggagctggaccacgccctcaatgacatgacctctattaactatctgacagtagagtggggctgggatcttggcttgtgggtggatgggggtacaagctatgcatagtggtgtgctttggttttatcctttg

SEQ ID NO: 327143 - DNA, 597 bp, Homo sapiens
ccctctcttcatctgcttctgaaacccttcactctgtcccctcattcctccctgtggttcctgtgcctgtccagatgagctctatgcccagaaactgaagtacaaggccattagcgaggagctggaccacgccctcaatgacatgacctctattaactatctgacagtagagtggggctgggatcttggcttgtgggtggatgggggtacaagctatgcatagtggtgtgctttggttttatcctttggaaactagaatctccacccttatctttgaaacattggtgctggttatttgtttggcaaaagctttggaggcatggccgggcgcggtggctcacgcctgtaatcccagcactttgggaggccgaggcaggtggatcacgtgaggtcaggagttggagaccagcctggccaacatggtgaaaccccgtctctactaaaaatacaaaaagtagccaggcatggtggcagtgcacctgtaatcctagctactcaggaggctgagccaggagaatcgcttgaatctgggaggcagaggttacagtgagccaagatgtgccactgcatttcagcctgggcaacagagtgagaccc

SEQ ID NO: 327144 - DNA, 1924 bp, Homo sapiens
gtccaatgccccccacatccctgtgcacctgggtgccatgcaggagacggtgcagttccagattcagcacctgggggccgatctccaccctggcgacgtgctactgagcaaccatcccagtgccgggggcagccacctgccagacctgactgttatcacaccggtgaggggtgctgcccgcctgcctctgctggggcagtggtggccgatgcagctgaccgtggctctccacccgctaggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggaggcggtgacggaggccctgcgggcgccaggcaaggtccccaactgcagcggaaccagaaacctgcacgacacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattcaaaaaaaaaaaaaaaaaaaaaaaaaaaaaaaaaaaaaaaaaaaaaaaactcgagggggggcccggtaccaggtaatctactgcctgcgctgtctggtgggccgcgacatcccactcaaccagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccaggtgcgggggcggggtgggcgcagctcgggggcggactgggtgggcaggctggagtaggagcgggagggcgaggtggggacgccctgccccagcccagcgcagcgaccaggtgccctcaccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccggtacccggtcatcctgcgccgcttcgagctgcggcggggctcggggggcagaggccgcttccgaggcggcgacggcgtcacccgcgagctgctctttcgtgaggaggcgctgctgtcagtgctgaccgagcgccgcgccttccggccatacgggctccacgggggcgagcctggcgcccgcggcctaaacctgctgatccgcaaaaacggccggacggtgaatctgggcggcaagacgtcggtgaccgtgtaccccggggatgtgttctgtctccacacgcccggcggcggtggctatggggacccggaggaccccgccccaccgccggggtcgcccccgcaagcactggcctttcccgagcacggcagcgtctatgagtatcgccgggcccagaaggccgtgtgaggatcccgcaataaaaatgccttaagtctcccggttctggggacgcagctacggcgcctt

SEQ ID NO: 327145 - DNA, 1070 bp, Homo sapiens
  misc_feature (836)..(836): n is a, c, g, or t
ccaccccgcacaacaaacgctcccaaatcgcgccgctatggtaattcgacggtcccgtgggtttacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataactgaattggcaagaagggcctctggtacaaggtggggacagactgtttgnctgaattgactcggtaaacggcccaagatcaaacccgtgtggatggactctcctctggccagattcgcgctggaggccagttgggtgaactggcctaaagagaggggggactaccacgggaaggggagcgcctttcacaagccctctttccacgggtatacgaccaaggtgtagcctcccggaacccacgggagacgagaccagagacgacacagagagagcagcgcgattatc

SEQ ID NO: 327146 - DNA, 2254 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggtacggagatggtgaggctcatgagggaggggcaggcgctggagtatccggcaagcggaataaggtcccttttgccgtggagcacggtcctctgaaggccggcgggctcggagatgaagttgggatctcggaggatgggctgaggctgaggtggcctccttgaaccgtaggatccagctggttgaagaagagctggaccgtctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327147 - DNA, 1568 bp, Homo sapiens
actccacccggtggctactcgtccacggttggctactagtccacggttggctactagtccacggttggctgaagaaatactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327148 - DNA, 1353 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccaacgtgaggctgagctgctcaccatgctgcagcaccagcacatcgtgcgcttcttcggcgtctgcaccgagggccgccccctgctcatggtcttcgagtatatgcggcacggggacctcaaccgcttcctccgatcccatggacccgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagcccagcaacgccacagcatcaaggatgtgcacgcccggctgcaagccctggcctaggcacctcctgtctacctggatgtcctgggctagggggccggcccaggggctgggagtggttagccggaatactggggcctgccctcagcatcccccatagctcccagcagccccagggtgatctcgaagtatctaattcgccctcagcatgtgggaagggacaggtgggggctgggagtagaggatgttcctgcttctctaggcaaggtcccgtcgtagcaattatatttattatgggaattc

SEQ ID NO: 327149 - DNA, 1868 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacctgtaatagtttatgctgtaatagtttatgctgtaatagtttatgct

SEQ ID NO: 327150 - DNA, 2055 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatatttgaacttgttggtgtggacctggaccattggtggaaggtttcgcgggtggagtgtggttaagtgcttctaacggccatttgggagtctggggggtgggagccgggatgggaagaccctaggggtggggggaagaaaaaagggggtaatacagttttaaacccaaaaagggggtggtagtagagttagggaggttgattatgataatatctgg

SEQ ID NO: 327151 - DNA, 2234 bp, Homo sapiens
  misc_feature (2200)..(2200): n is a, c, g, or t
  misc_feature (2202)..(2202): n is a, c, g, or t
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaaaaaaaacaaacagaacacaaacaaacacacacaaacaaaacaaaacaaananacaaagacgaaacaagacacacaaccaaaaca

SEQ ID NO: 327152 - DNA, 2290 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaaaaaaaaacaaggggggcccaaataatctgagggccatttacggtccggtttgtcaagggcccaaagggcataagcagagggcggtcaaagcgctggaacgatggtttgggacctctggggatggacaccagaagcggtaa

SEQ ID NO: 327153 - DNA, 2149 bp, Homo sapiens
tccagacacaccaaatatcggcataagtacgaggctcggtgtttatatcggacgagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaa

SEQ ID NO: 327154 - DNA, 1221 bp, Homo sapiens
cggacgcgtgggtcgacccacgcgtcgagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcacttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccaaat

SEQ ID NO: 327155 - DNA, 1433 bp, Homo sapiens
ggctctcgctgggaatggcggagggagagaaaaaccaagatttcactttcaagatggaaagtccgtcagactcagctgtggttttacctagcactcctcaggcctctgcgaatccatcatctccctatacaaatagttcccgaaaacaacctatgagtgcaacacttagagaaagattaaggaaaacaagattttcatttaattcctcttacaatgtggtgaaacgtcttaaagtagagagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcacttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccaaat

SEQ ID NO: 327156 - DNA, 624 bp, Homo sapiens
agaaaaaccaagatttcactttcaagatggaaagtccgtcagactcagctgtggttttacctagcactcctcaggcctctgcgaatccatcatctccctatacaaatagttcccgaaaacaagtatgaaaatctttgttcttccagtggatccattatgtgtttctaagtattgtggcagtggtggtttaaattctacggaaggttgttaattaacataatgtgtagcataaataagtagacattttattaaataattttgtttttcttctaaggtgacatatatgacacccaccagcccccttccatattttcctcttgaatgaattcatttcagttagtttcagattaggttattacaatactccagatggagaaagtttgcatctgtgcaatattattatgaaggtctttagtggcagagtctaggtcttttccttactctgtaattctgaagcacctggagtactatcaggcatgtgcttgttactgaacaaatgttccttgattactgggataaacttctcaacacttttggaaaggtgttgatcttgctgaagtaaaaaggaaataaaacaaatggagcttccagaaattaaagtcattttgtgatgccttctttaga

SEQ ID NO: 327157 - DNA, 1503 bp, Homo sapiens
agcggcgcctcgcgcgtcaggcaatctggccaattgcgcatcttttccgcctaccgcacggccccgcccctgccacaggatcgatttacggccgcagagaaaaaccaagatttcactttcaagatggaaagtccgtcagactcagctgtggttttacctagcactcctcaggcctctgcgaatccatcatctccctatacaaatagttcccgaaaacaacctatgagtgcaacacttagagaaagattaaggaaaacaagattttcatttaattcctcttacaatgtggtgaaacgtcttaaagtagagagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcacttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccaaat

SEQ ID NO: 327158 - DNA, 687 bp, Homo sapiens
agcggcgcctcgcgcgtcaggcaatctggccaattgcgcatcttttccgcctaccgcacggccccgcccctgccacaggatcgatttacggccgcagagaaaaaccaagatttcactttcaagatggaaagtccgtcagactcagctgtggttttacctagcactcctcaggcctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccaaat

SEQ ID NO: 327159 - DNA, 3285 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctattgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagtttta

SEQ ID NO: 327160 - DNA, 720 bp, Homo sapiens
  misc_feature (544)..(544): n is a, c, g, or t
  misc_feature (637)..(637): n is a, c, g, or t
  misc_feature (693)..(693): n is a, c, g, or t
  misc_feature (710)..(710): n is a, c, g, or t
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctgactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtanttgtggttgactggctccccctggcccaccagctttacacggatgcggtcaataataccagggtggtgggacacagcattgccaggatgctcnaactgggctgcaaggagaaaggacgatttttctctccgggaaatgtccactttgantcgggtaaaagccctcncgaagcgcaa

SEQ ID NO: 327161 - DNA, 2514 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaaaaaaggcgccgctgggatcctctgatcacccgac

SEQ ID NO: 327162 - DNA, 2884 bp, Homo sapiens
cgatatttgtggttctggctctctgagaaggctgggagactctgttgtaggcagctgtgggagaaggctagggttggaggtacacctggagatgtgtcagtttggtgttggcactgcagattcagcgcccgtggtccctgactaaggcactctgcctagatctattttcccctgactgtaccttttatgccccctggctttcccattctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctattgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagtttta

SEQ ID NO: 327163 - DNA, 2471 bp, Homo sapiens
gatcatagttttttccctgatttttttcacttcataaagaatcaaatttctctgttacttagtattattttatagaaatacttaaaatgtatcatttattagttttttaaagtacagagatgtgtcaagatgtgtaagaaggcaagtagtacataatctcatgcagcaatattttaatatattccattttataaatatagtataattagctccttgtttttggacatttgggttgtttctgatttttttgctactttaaagtgtgctgtagtaaacatctttgcatgtttctatgattgtttttttaggataaattcctggaagtggaattgctgggttaaatgtgtggaatcatccagtcatataatgaagatactttaccttgtaggtttcaacctacaggactcagctgcttatttctccttccctcttttgtagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctattgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagtttta

SEQ ID NO: 327164 - DNA, 1175 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggtagggaaggctcacagctttttttcttttttctttttttttaagatggagtttagctcttattgcccaggccggagtg

SEQ ID NO: 327165 - DNA, 1137 bp, Homo sapiens
tcactagatcccgcgcgcgagtgaggaagcatataccacagaacatttggtgtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctattgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagtttta

SEQ ID NO: 327166 - DNA, 3255 bp, Homo sapiens
gcagtctgggaaactagaggcagggtggcaggagatgccacagcttgcagggcacagttgaggagagcagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctattgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagtttta

SEQ ID NO: 327167 - DNA, 2340 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaaatggtcgccaatccggggtaccgagctcg

SEQ ID NO: 327168 - DNA, 2500 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgatctataggagtggtgcaccactcctatagatcagtcatcatgcaaataaaagccacctgagtcaaaggcaaagccagagtgcagcttggagcaaagaagttaaaagcatattggcagaggaagagccctggcattccagcaggagctaacaggaaaaagaaatcaatggcagtaccctgacacagccttctggtggtacactcactggggatc

SEQ ID NO: 327169 - DNA, 1057 bp, Homo sapiens
ggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggctgccctagccctggacctgtctccgagtacatagacgtttcctgtgtgcctcctgccaggggttaaataggtcaatgtttttccagataattgaatattgaataagttagtcaattaaatacttttttaggtttttaattagagactacttaatgaaatatgtaatttttattatgtataatagaatgtgcaaattctagataaagatactaccactatacttatttactatctttacttactcaaaagatcctacagactaacaaaacatgcatctttaaagctcacattaggacgggcttgacatgtttaaacaactattgctgctacttcttatc

SEQ ID NO: 327170 - DNA, 920 bp, Homo sapiens
cagtgacatgtcctagctcttagaaaatttcatgatacttgctttggcctttggcagacagagcatgaacccattgggtaggaattgacattgaagctgactcaacggattatggaagtggtgaataaaaaaaagacaatgcttgcactcctggagcctatagtctaggaggggagacaagccaaatatagataatcacccaaataagtacttaatttcagttctgtaatggaaaagttaagatttcaagaaagattaaaccagggacctaaatttggccactgtagagatggtatttaaggtcttgagagaagctgaaattgcaaggcagaatatgttgtgatatgaactccccaagaactcaagaatttagaatttggtaggaaaaggaacagaccaaaaaaaaaatcctcagaaagaactgtcataaggtgtaaataaaacaaactaaaaacccctattttatcactgaagcggaagagagagtgtttcagaaggaagatatggttaactgtataaagggctgctgagtggtcaagtcagatgcaggcagaacattgacattggataaactggtgaccacgacaagagcagtttctgcaatgtggtgaagcaggaagccagaatggaaaggagaggaggagataaagtagaggcagtgcctatgcataatggtcaaaaagcgtggctgttaaaggagaatagacagaatgggtgataacttgacagaggtgtggagttagggaagttttcacttgcttggctttgtttgtgagggtggattcttgcatatatttgagtgctgaagggaaaaatccagtagtgaggaagaggtcaaagatttggaaaagagagggtatagctgacagaacaagagccctgaccagggaggaaggcatgagatccaggcacctgtggag

SEQ ID NO: 327171 - DNA, 135 bp, Homo sapiens
ttgctgtcctcatatccagtcctcccaagtagattcactcatttccacatcaaagatagaggcctcataggagccgagatgaaaagtagccttgtgttgctacaggctggccccctgggcaaataaagaagtgca

SEQ ID NO: 327172 - DNA, 279 bp, Homo sapiens
tgtgctctcttgccctgatgctgaaggaaagtcacctcaatggctctgaattcaatggtctcaattgtttggctggaaaattagaaaacccagagaagaaggaagattatattgactccctcagcttccaactcttactcttgccgcgtgtgtccctgctgtggaattcactcattaaatcaatttgttttttaatacataataagcatttattttgtccaaggcatggctgcccaagatgatcacctgaagtgcacccacattgttttgtgaataaag

SEQ ID NO: 327173 - DNA, 2357 bp, Homo sapiens
gattactcacacagtcttgaagatgcaatgtcagctatttaggacagaaacatccaaggccgtgtcagaactcaattacgactacatatgcattaaggcaggaactggcaggcctcagggtacgccaactataggactcgtgcttctcgtacgctgggctataatctatgaaactgagctccagagccagccaatcacttagctcctcataacaagtctaactggctctggaaagctgaaagggctgcactggaacaacacagatgagatattctacacattaatctacttatctggaatcactttgcctctaaaggccagagaaaaatcacagcttccttgtcggaggggaaaaggacaggtgatctggggaaaacgcagctacacctggagcaaggtctcttcccggcttggcaatctcagctgtgccggcgctacgggacccgagccgtcccagaaaccaaagggcaggcacggcagcaaacgcctgagtgctgctgccttcggtgactatatgagaatggaaacttctaaggaagccaggttgttagaattgttaccccctttactcagagataacatagattatccaggctgagatggaaaacaagccctttattgaattttcaacacagactccctgcttctcatctccttaataaaatttcattaaaatccccttgaactcccatgttcaaatctccatttgttgacagacaaagccaacaatactctaaactgaggcctgcaagtcatttcatttgtatttttgtccagaaatttcccataggaagacttcacctcctacaactccgaagaaaacccttactgtccaagaccgtcaccagcaaccatccgcagtcattcaagtggaagctttcacagcttttgtacattctctgtgtcaatatacaactgagttacagactgtcccctggctccctgacccttacaaacactaaaagttttgtttgactcaacttcaagctgctcatctgttagtaagtgatgttcactccagaacacattcatgatgagaactttctaaaagaccagcactgctcttcccctcctataatcataataatcatgataacctgaaacatgttactgggactcgacatttttctggggattgaaatctttagtccttggagctgtcacatagcaggggcaacctcacactgaaacaaaggaagtgatgtcccattattatccaccctgagccaccataatatgctgtttacatttattttcttcagcctgtgcaaaacaaagcaatggaaaaggaaactaaaaaatatacatactagtaccattatcttcttttgcctaaaattactaatgcaccacgtcagtctgcttccttcaggcatcattctcaattcatcaggacttgtattagcaggttctggctagagagactatctcctgtcatcacgatcaattaatgttttctggtgatcacatcaggccctatctaagaagctcatggtatacaagggtcacccaaatagctgagtgcagtccttgctcatatttccttcatcttaaccccgcaaacaagaattaagatgatcccaataaaagaaaaattgctcaggaaactgaacctttttctgaaccaagcactgtcagcaaatctcaggtattagagcaactatggttgattgaaaagtgtctcaaaatctgggccaagaatgattgctaggtccataagctaatttgtctggccttgccatttacgtaagccaaagaaagtcactcatgagtaaactatagaaaacgttcagacccatcctgttagtatgtcaaatcaactaagactggcagggtattaactccattccaggtgacatggataaagagccccattattttcacagtgccagcctctacctaaggaaaccctagaccttggaaccagtttcctggtagggaactgctgacagtttcaatgctgacagttggagccaatgcctcatagtgtaaactgaaagaaaaatagttgctttttaaaatgtcagcaagaaggcctgcctcatcttaacaaagcaaaaaaaaatgctttaattcaaattaaaaatcatgatactagagatgggagtctgtggtcactataaagataaagttcatgttcttggttcagataacaaaacactttatctggataaatggacctcaaaatttgctcttggcacatgggggaaattttttgttgtattttgttgttgttgttgttcttgttgttattgtttaaattaatcttcctaaggccatgaatatgaaatcatattaataatgcatgtgacaaaattctaaaatatattacacttaaaattagcataaaccatcaa

SEQ ID NO: 327174 - DNA, 1010 bp, Homo sapiens
gattactcacacagtcttgaagatgcaatgtcagctatttaggacagaaacatccaaggccgtgtcagaactcaattacgactacatatgcattaaggcaggaactggcaggcctcagggtacgccaactataggactcgtgcttctcgtacgctgggctataatctatgaaactgagctccagagccagccaatcacttagctcctcataacaagtctaactggctctggaaagctgaaagggctgcactggaacaacacagatgagatattctacacattaatctacttatctggaatcactttgcctctaaaggccagagaaaaatcacagcttccttgtcggaggggaaaaggacaggtgatctggggaaaacgcagctacacctggagcaaggtctcttcccggcttggcaatctcagctgtgccggcgctacgggacccgagccgtcccagaaaccaaagggcaggcacggcagcaaacgcctgagtgctgctgccttcggtgactatatgagaatggaaacttctaaggaagccaggttgttagaattgttaccccctttactcagagataacatagattatccaggctgagatggaaaacaagccctttattgaattttcaacacagactccctgcttctcatctccttaataaaatttcattaaaatccccttgaaaaaaaaaaaaaaaaaaaaaaccaacaaaaaaaaaaaaaaaaaaaacaacgccaaaagtacgacacaacagcaacataaccaacaacagtaccacacaaagcaaacaccacacgagctggggggcggccgcggcgcccacaaaaagatgtctcaaacaccaacacgagggggggaggcagccgcgcacagtagtaagtgaacaacatggctgaaactgcggcactgtcaacaaacgcgcccgcaaaaagaggggggggtccccccaaaaaaaaaccgcgggggaagaacgcgggttgaacacacaccgggtggagggatacggggc

SEQ ID NO: 327175 - DNA, 685 bp, Homo sapiens
gattactcacacagtcttgaagatgcaatgtcagctatttaggacagaaacatccaaggccgtgtcagaactcaattacgactacatatgcattaaggcaggaactggcaggcctcagggtacgccaactataggactcgtgcttctcgtacgctgggctataatctatgaaactgagctccagagccagccaatcacttagctcctcataacaagtctaactggctctggaaagctgaaagggctgcactggaacaacacagatgagatattctacacattaatctacttatctggaatcactttgcctctaaaggccagagaaaaatcacagcttccttgtcggaggggaaaaggacaggtgatctggggaaaacgcagctacacctggagcaaggtctcttcccggcttggcaatctcagctgtgccggcgctacgggacccgagccgtcccagaaaccaaagggcaggcacggcagcaaacgcctgagtgctgctgccttcggtgactatatgagaatggaaacttctaaggaagccaggttgttagaattgttaccccctttactcagagataacatagattatccaggctgagatggaaaacaagccctttattgaattttcaacacagactccctgcttctcatctccttaataaaatttcattaaaatccccttgaa

SEQ ID NO: 327176 - DNA, 577 bp, Homo sapiens
acacattaatctacttatctggaatcactttgcctctaaaggccagagaaaaatcacagcttccttgtcggaggggaaaaggacaggtgatctggggaaaacgcagctacacctggagcaaggtctcttcccggcttggcaatctcagctgtgccggcgctacgggacccgagccgtcccagaaaccaaagggcaggcacggcagcaaacgcctgaggtaattttcatctttctttttatttttagtagaataatgcagactgaaagtgataagcataaagtcgctgaggcaactagatatgcttcgattttattttacattttcctattctaatcgtgtgcaggatcatttgttatgaagtctgaggagggggagaattaatgtacctgaaataaacttgaaactaaaacgatcatttgtggaggaaaatacaggattttccagaacagtttcagagctacctttgcagatgggtaggcttttcacccacccacagaaagaagagtcaacggggctgagacaggacagggatgggtttcaggagcacaattaaaagtttttcgtatcttaaagaaa

SEQ ID NO: 327177 - DNA, 281 bp, Homo sapiens
tcgggaggctgaggcaggagaatcacttgaacccgggaggtggaggttgcatcaagccaagatcgcaccactacactccagcctgggcgacagagcaagaccccatctcaaaaaaagaataaaagaaagtcccatgtcccaggaaacccctgggacccaggcaaagggggatagttggtcaccctagaccgcctccccctcctacatatgggcaaactgaggcccagggaagggagggactagcctaagctcacccagtcagaggggaatgtgttcatggc

SEQ ID NO: 327178 - DNA, 433 bp, Homo sapiens
atctcaaaaaaacagaaatgaaaacaaacgttttcctctgaaagcaagcatcctgttaccccagacaactatggtatgggtagctctgaacctcaaccatgaattatttcagagttttttcaaactgaaattgaaattaatgcccagccttaactgttcatgtagaaatatttcttttctgacaaatctagctcttgcaaatctatgcttagtagagacggggtttctccatgttggtcaggctgttctcaaactcctgacctctagtgatccacccgcctcagccttccaaagtgctgggattagagcataagccaccatgcctggctggcaaatatatacttctaaacaattatgctgctttagtataattgttttttatatatttttgtactgattaaagatatccttacaataagtctaattgaattat

SEQ ID NO: 327179 - DNA, 762 bp, Homo sapiens
gtgctggtatgatctccctgtttacagaagaggaaacttgagaagttaagcaacctgccaaaggtcttagagcctgaaagattagcccatcgaccaaatccagccaggctttacagccagcacaaacatcggtcaggtggcctagggcaagtcattcaacctctcagaacttcagtttgtgatgtcagttggggataatgatacttgccttgcagggaaggaagagacagctccagctcccttttcttggcatcccagtcttcatcacgctcatccagaggcagccccttctgctgggcagcgcaacggtggtcctggcactcgggctctgccctaggaaagaagagagagccttctgaacttggatcaggaggacctgttccagcctgggaatcggcctttattcacaggttctgcacaccgcagttcagttgagaaggaaggaggccaagtttgagcatttccaagcatacacttagggaaggtctcagacactaaagaaactacttggaggtggagaaaaattgtgggacccgagtgagatgttaacagactcaaagatagtcactcagcttgaagaaaatgctcctgattcttgaagtgctcacatttatagagcaacctgcagattattgcgagactgttttcgtttatttttagttttatttttcataatcataaaagtgatgtgtgttccttgtataaaatttaaaagtacagaaacatataaggaacaaaatgagaatcactcacaatcacata

SEQ ID NO: 327180 - DNA, 2007 bp, Homo sapiens
gattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggagttgtcaggggagtgtccattggcagcacctgcctcctgagtgtctcccaggccatcaccatcagccccaggagctcaggtgggcagagcttaaagggaacgcccccaagcacgctggctcctgtgtgttcctcagctggctcctccctggtcaatatcattgttctcatgcacgtgaccggcaagtggagcaacaaaaataccacgaagacaaaagatctgggatactgttctgctgctgatcacgagggcaccagagagtcgctgacgcggcactgctgtccttccctgatgtgatctgcctggggctcatgctctggggcagcagctccatcgtttgcatcctgcacaggcacaagcggcgggtccagcacattcataggaccagcgtgtcccccacatcctcccctgagtccggagctaccaaaaccatcctcctggagcaggaaaggacaaggagtccccgaagctgacactgagttcatggggttgagctgacagcggccaacaggctgtgatgggatctcactctgtcggccaggctggaatgcaatggtgccaacttggctcagtgcaacctccccaccccgggctccaacaatcctcccatctcagcctctgaagtagctgggactacaggcgttatctcctgtccggggaagaggtgggcctctctccgtcgtgggaggagctctgaacttctccttcatccagggatgggccccagggacccaccagtggggctgggagaagcccccctcagcaggaagacagaggtgcctgggtggccgaggcctggaaggtctgcaccatggtgcacagaggccccggagctgggtgaggccagaaagctgctctggggtcagcggggaatgtgcctgctgaatctgtacctgagctacgtcttcacaaatggcctcagacctagagtgcagggagatcccctggcttttctgaagtggtggcaggtggtctcctgggtagcaggatctgggctgcttacttcccttacccagtgagggcccgcggggagctcttaagttgggcatcatggggctgcgtgatgtggctgctgtgcccacatcagagggtttttgtttcttttccaaagtcaagctgcactaatctagaccagggatccccacccctgggctgcagaccggtccccatgggtggcctgttaggaactggaccgcacagcaggaggtgagcagtgggtgagtgcgcgtgaccacctgagctctgccttctgtgagatcagcagcgccactgcatctcagaggaatgccaaccctactgtgaactgtgcatgcgagggatctgggttgcatgctctttatgagatcaaactaatgcctgatgatctcaggtggaacagtttaatcctgaaaccatccccccatctgtggaaaaactgccttccactaaaccagtccctggtgccaaaaacactgggaaccgctaatctagacagttctctgctaaggaagcacgtggttgagaagcatcagaatcgttcccacggaccatgctccggagtctcagcaggctcctgcagtgtgtttatccgtgcatcatgaaggaccctcatacggctgacgtgccttggctgatgcgaataacactgcagcaagcgtggcagtgcagatagctcttggaaatacccatttccttcagacgcatactcagaggtaggattgctggattgtttggtcattttgatttttaaaattaaaaagaattttaattctcatattgttttgagtaaaattaaattataacttgtaaggc

SEQ ID NO: 327181 - DNA, 837 bp, Homo sapiens
gagggactgaaggtcacaccacagcgcgctggagggcagttgtgcgatcttgattcacttcaacctctgctctccgggctcaagcaattctcccacctcagcctgagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctgggtgaggataacttccctccagaagtggggatgtgcccttgtggatctttgtattttctcttgtttctcttgggagttgcatccttgcttgactaaaatggaagctgtattgattttgaaatgaaaagcttcatgatacaaaaaaaaaaagaaaaaagaaaaaaaatttttgggcgggcttgggccctaagaaaggtttcaccaccactccggtgggcgccgggggcccagataggtatagggaacgtgggcaaaggggggccccaggggatacccgtgggcaagaaaaggggggggatctcccccatataaaaaacgccggcggaaaacggacggttgagaacaccaaagagatccggaggcaaaggggcctatacaacggggtcaaggaacgataata

SEQ ID NO: 327182 - DNA, 1146 bp, Homo sapiens
actgtgttgattcaaggtttaatggatttagggctgtgcaggatgtgctttgtttaaaatgtgtttgcaggcagtatgcttggtaaaagtcatcaccattctccagtctcaaataccaagggacacaatgcactgcagaaggccacagggacctctgccccagaaagcctgggtattgtccaaggtttctgcctgctgagacagcctgagatatggcctcatgggaagggaaagacctgactgtcccccagcccaacacccgtaaagagtctgtgctgaggaggattagtgaaagaggaagacctctttgcagttgagataagaggaaggcatctgtctcctgctcgtcctggcaatggaacgtctcgctgtaaaacctgattgtacattctatttactgagataggagaaaaccgccttatggctggaggtgagacatgctggcggcaatactgctctttactgcactgagatgtttgtgtaaagtcaaacataaacctggcctacatgcacattgaggcacagcacctttccttaaacttatttatgacacagagacctttgcttacgttttcctgctgaccctctccccaccattagcctgtagtcctgccacattcccctcactgagatggtagagagagtgatcaataaatactgagggaactcagagaccagtgccgatgcgggtcctccgtatgctgagcgccggtcctctgggcccagtgttctttctctatactttgtctctgtgtcttatttcttttctcagtctcttatcccagctgatgagaaatagccacaggtgtggagggactggccccccttcagggttttatgccttgggcttaggttgtaatttggcagggcagccttccaccctttggcacagagctgggtgttccaaagaccacaaggggttttaggccctggaccccggcatgttccaagactctttatattatgtcagactagcaagccctgcctcagcttttccccaacatggaacgctgttctaaaagcacccatgattcttttttttcttttttttcttttttttttttttcagatggagttgcagtgagctgagatcgtgccactacactctagccttggtgacagaacaagactctgactcaaaaaaaa

SEQ ID NO: 327183 - DNA, 797 bp, Homo sapiens
gctgatcacgaggacaccagagagtcgctgacgcggcactgctgtccttccctgatgtgatctgcctggggctcatgctctggggcagcagctccatcgtttgcatcctgcacaggcacaagcggcgggtccagcacattcataggaccagcgtctcccccacatcctcccctgagtccggagctaccaaaaccatcctcctggttctagcatgtattaacaccgtgtgtctaaagtcatccctgctggtcatctggaggaatctgagaaggggcaggtctttcttctgactctcagagcagcaccctctgctggacagggctgggcacctcatctcaagcccaatctgatccaccaacagggtctgttatctccggtccggggaagaggtgggcctctctccatcctgggaggagcgctgagcttctccttcatccagggatgggccccagggacgcgccagtgggactgggagaagccaccctcagcagggaagacagagatgcctgcgtggccgaggcctggaaggtctgcaccatggtgcacagaggccccggagctgggtgaggccagaaagctgctctggggtcagcggggaatgtgcctgctgaatctgcaagcacctgagctacgtcttcacaaatggcctcagacctagagtgcagggagatcccctggcttttctgaagtggtggcaggtggtctcctgggtagcaggatctgggctgcttacttcccttacccagtgagggcccgcggggagctcttaagttgggcatcatgggtctgcgtgatgt

SEQ ID NO: 327184 - DNA, 841 bp, Homo sapiens
cgctgcgcatacgctaacttgaatcatatggtctgggtgcctcatagaatggttttcattcaatcaggcatcggtttggtccaaccagttttacattaaaaaaaaacagtgatataaaagtggatatttaatttattggtgaggatgacgttgaggatatcctctagtactggatccacaagagaaatctctcaggagtcagtctcagtatggctcagcgctgcaaataataaatgatcaattatatacatacataaaacttcctaatatttcacttagtattgctattactatgttcttggggcagaagctcagtctgtcagatacattacgagagactggtgtctccataattgtgcttaggactatgttgcatgaatggataaactgttaagcaggaacctaggagagctagggtgacaaagttcaagtccattaaaactagcaagacatattccttacagctcatgcacgagtcaccgtcataagatgtttatggttaaggaaagcagcttattgatacctgcaaggacaaatttctacagaaacacaatgtccagatgacccaatatcccatgacaatgtatgcttttaagatagcaggctggtctcggactcctgacctccggtgatccacctgcctcggccttccaaagcgctgtcaatacaggcgtaagccattgcgcctggccaaggatagctttaaatcaacaaagtaataagttttgttacagtgtcagcccacccgcaggtagacataccttagcttttacgtaggctttggccgggcgcggtggctcacgcctgtaatcccagcactttgggaggccgaggcaggtgg

SEQ ID NO: 327185 - DNA, 1891 bp, Homo sapiens
ggatagcgtggagtgacggtgccaccgcggcgcagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggaaaggagaatcacttgaacccaggaggaggaggttgtggtgagccgagattgcgccattgccctccagcctgggcaataacagtgaaaatctgtctcaaaaagaaaagaaaagaaaaaaagatatatactcccctaagaaaagaaaaaaagctatatactcccctcacaaactggggacctcaagatctccaccctaaaatagttattttgaatttccccctggcaatgtaaaccgagagcttatctgcacaggtgtgggacagaaccaatccctctgcacacctgagacaaatgcctatctgattgcttcccctgccctattgtttacataaaaacgcagggtcactgaggcagtcgaaggcataagtgactattcctcctcccgctctcacatataaattgtgtatttagtgaaaggttgatcaaagactcaaagaatgtgatcatttgttatctacctgtgacccggaagccccccaattccagttattccacctttccagactgaaccaatgcatatcttacatgtattgattgatgtattatgtctctgcaaaatgtgtaaaaccaaactgcagcctgaacaccttgggcacacattgtcaggacctcctgaggctgtgtcacgggggcatttttaaccttggcaaaatagatttctaaattgactgagacctagtagatacttttagttcacaagctcatgaacgcagaagaaattgagagaataagaaaaaagctaggtgtcatggaaagcacgaaatcagttccaaaatctgaactccttcatatttattcaacatagggaaatgctcttcaactttgtgtgattagattccatttgcgaatgatatatatttctagtatttgattaaaataacccattctatgtaattttagccaacttaaactgcaaataataaatgatcaattatatacatacataaaacttcctaatatttcacttagtattgctattactatgttcttggggcagaagctcagtctgtcagatacattacgagagactggtgtctccataattgtgcttaggactatgttgcatgaatggataaactgttaagcaggaacctaggagagctagggtgacaaagttcaagtccattaaaactagcaagacatattccttacagctcatgcacgagtcaccgtcataagatgtttatggttaaggaaagcagcttattgatacctgcaaggacaaatttctacagaaacacaatgtccagatgacccaatatcccatgacaatgtatgcttttaagatagcaggctggtctcggactcctgacctccggtgatccacctgcctcggccttccaaagcgctgtcaatacaggcgtaagccattgcgcctggccaaggatagctttaaatcaacaaagtaataagttttgttacagtgtcagcccacccgcaggtagacataccttagcttttacgtaggctttggccgggcgcggtggctcacgcctgtaatcccagcactttgggaggccgaggcaggtgg

SEQ ID NO: 327186 - DNA, 3055 bp, Homo sapiens
actgtgttgattcaaggtttaatggatttagggctgtgcaggatgtgctttgtttaaaatgtgtttgcaggcagtatgcttggtaaaagtcatcaccattctccagtctcaaataccaagggacacaatgcactgcagaaggccacagggacctctgccccagaaagcctgggtattgtccaaggtttctgcctgctgagacagcctgagatatggcctcatgggaagggaaagacctgactgtcccccagcccaacacccgtaaagagtctgtgctgaggaggattagtgaaagaggaagacctctttgcagttgagataagaggaaggcatctgtctcctgctcgtcctggcaatggaacgtctcgctgtaaaacctgattgtacattctatttactgagataggagaaaaccgccttatggctggaggtgagacatgctggcggcaatactgctctttactgcactgagatgtttgtgtaaagtcaaacataaacctggcctacatgcacattgaggcacagcacctttccttaaacttatttatgacacagagacctttgcttacgttttcctgctgaccctctccccaccattagcctgtagtcctgccacattcccctcactgagatggtagagagagtgatcaataaatactgagggaactcagagaccagtgccgatgcgggtcctccgtatgctgagcgccggtcctctgggcccagtgttctttctctatactttgtctctgtgtcttatttcttttctcagtctcttatcccagctgatgagaaatagccacaggtgtggagggactggccccccttcagggttttatgccttgggcttaggttgtaatttggcagggcagccttccaccctttggcacagagctgggtgttccaaagaccacaaggggttttaggccctggaccccggcatgttccaagactctttatattatgtcagactagcaagccctgcctcagcttttccccaacatggaacgctgttctaaaagcacccatgattcttttttttcttttttttcttttttttttttttcagatggaatggagtttcgctcttgttgctcaggctggagtgcaatggtgtgatctcggctcactgcaacctccgcctcccgggttcaagcgattctcctgcctcagcctctcgagtagctgagattacagagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggaaaggagaatcacttgaacccaggaggaggaggttgtggtgagccgagattgcgccattgccctccagcctgggcaataacagtgaaaatctgtctcaaaaagaaaagaaaagaaaaaaagatatatactcccctaagaaaagaaaaaaagctatatactcccctcacaaactggggacctcaagatctccaccctaaaatagttattttgaatttccccctggcaatgtaaaccgagagcttatctgcacaggtgtgggacagaaccaatccctctgcacacctgagacaaatgcctatctgattgcttcccctgccctattgtttacataaaaacgcagggtcactgaggcagtcgaaggcataagtgactattcctcctcccgctctcacatataaattgtgtatttagtgaaaggttgatcaaagactcaaagaatgtgatcatttgttatctacctgtgacccggaagccccccaattccagttattccacctttccagactgaaccaatgcatatcttacatgtattgattgatgtattatgtctctgcaaaatgtgtaaaaccaaactgcagcctgaacaccttgggcacacattgtcaggacctcctgaggctgtgtcacgggggcatttttaaccttggcaaaatagatttctaaattgactgagacctagtagatacttttagttcacaagctcatgaacgcagaagaaattgagagaataagaaaaaagctaggtgtcatggaaagcacgaaatcagttccaaaatctgaactccttcatatttattcaacatagggaaatgctcttcaactttgtgtgattagattccatttgcgaatgatatatatttctagtatttgattaaaataacccattctatgtaattttagccaacttaaactgcaaataataaatgatcaattatatacatacataaaacttcctaatatttcacttagtattgctattactatgttcttggggcagaagctcagtctgtcagatacattacgagagactggtgtctccataattgtgcttaggactatgttgcatgaatggataaactgttaagcaggaacctaggagagctagggtgacaaagttcaagtccattaaaactagcaagacatattccttacagctcatgcacgagtcaccgtcataagatgtttatggttaaggaaagcagcttattgatacctgcaaggacaaatttctacagaaacacaatgtccagatgacccaatatcccatgacaatgtatgcttttaagatagcaggctggtctcggactcctgacctccggtgatccacctgcctcggccttccaaagcgctgtcaatacaggcgtaagccattgcgcctggccaaggatagctttaaatcaacaaagtaataagttttgttacagtgtcagcccacccgcaggtagacataccttagcttttacgtaggctttggccgggcgcggtggctcacgcctgtaatcccagcactttgggaggccgaggcaggtgg

SEQ ID NO: 327187 - DNA, 2014 bp, Homo sapiens
ggatagcgtggagtgacggtgccaccgcggcgcatggagtttcgctcttgttgctcaggctggagtgcaatggtgtgatctcggctcactgcaacctccgcctcccgggttcaagcgattctcctgcctcagcctctcgagtagctgagattacagagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggaaaggagaatcacttgaacccaggaggaggaggttgtggtgagccgagattgcgccattgccctccagcctgggcaataacagtgaaaatctgtctcaaaaagaaaagaaaagaaaaaaagatatatactcccctaagaaaagaaaaaaagctatatactcccctcacaaactggggacctcaagatctccaccctaaaatagttattttgaatttccccctggcaatgtaaaccgagagcttatctgcacaggtgtgggacagaaccaatccctctgcacacctgagacaaatgcctatctgattgcttcccctgccctattgtttacataaaaacgcagggtcactgaggcagtcgaaggcataagtgactattcctcctcccgctctcacatataaattgtgtatttagtgaaaggttgatcaaagactcaaagaatgtgatcatttgttatctacctgtgacccggaagccccccaattccagttattccacctttccagactgaaccaatgcatatcttacatgtattgattgatgtattatgtctctgcaaaatgtgtaaaaccaaactgcagcctgaacaccttgggcacacattgtcaggacctcctgaggctgtgtcacgggggcatttttaaccttggcaaaatagatttctaaattgactgagacctagtagatacttttagttcacaagctcatgaacgcagaagaaattgagagaataagaaaaaagctaggtgtcatggaaagcacgaaatcagttccaaaatctgaactccttcatatttattcaacatagggaaatgctcttcaactttgtgtgattagattccatttgcgaatgatatatatttctagtatttgattaaaataacccattctatgtaattttagccaacttaaactgcaaataataaatgatcaattatatacatacataaaacttcctaatatttcacttagtattgctattactatgttcttggggcagaagctcagtctgtcagatacattacgagagactggtgtctccataattgtgcttaggactatgttgcatgaatggataaactgttaagcaggaacctaggagagctagggtgacaaagttcaagtccattaaaactagcaagacatattccttacagctcatgcacgagtcaccgtcataagatgtttatggttaaggaaagcagcttattgatacctgcaaggacaaatttctacagaaacacaatgtccagatgacccaatatcccatgacaatgtatgcttttaagatagcaggctggtctcggactcctgacctccggtgatccacctgcctcggccttccaaagcgctgtcaatacaggcgtaagccattgcgcctggccaaggatagctttaaatcaacaaagtaataagttttgttacagtgtcagcccacccgcaggtagacataccttagcttttacgtaggctttggccgggcgcggtggctcacgcctgtaatcccagcactttgggaggccgaggcaggtgg

SEQ ID NO: 327188 - DNA, 1774 bp, Homo sapiens
  misc_feature (1774)..(1774): n is a, c, g, or t
ggatagcgtggagtgacggtgccaccgcggcgcagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggaaaggagaatcacttgaacccaggaggaggaggttgtggtgagccgagattgcgccattgccctccagcctgggcaataacagtgaaaatctgtctcaaaaagaaaagaaaagaaaaaaagatatatactcccctaagaaaagaaaaaaagctatatactcccctcacaaactggggacctcaagatctccaccctaaaatagttattttgaatttccccctggcaatgtaaaccgagagcttatctgcacaggtgtgggacagaaccaatccctctgcacacctgagacaaatgcctatctgattgcttcccctgccctattgtttacataaaaacgcagggtcactgaggcagtcgaaggcataagtgactattcctcctcccgctctcacatataaattgtgtatttagtgaaaggttgatcaaagactcaaagaatgtgatcatttgttatctacctgtgacccggaagccccccaattccagttattccacctttccagactgaaccaatgcatatcttacatgtattgattgatgtattatgtctctgcaaaatgtgtaaaaccaaactgcagcctgaacaccttgggcacacattgtcaggacctcctgaggctgtgtcacgggggcatttttaaccttggcaaaatagatttctaaattgactgagacctagtagatacttttagttcacaagctcatgaacgcagaagaaattgagagaataagaaaaaagctaggtgtcatggaaagcacgaaatcagttccaaaatctgaactccttcatatttattcaacatagggaaatgctcttcaactttgtgtgattagattccatttgcgaatgatatatatttctagtatttgattaaaataacccattctatgtaattttagccaacttaaactgcaaataataaatgatcaattatatacattaaaaaaaaaaaaaaaaaaaaaaaaaaaaaaaaaaaacaaaaaaacaaaaaaaaaaacaaaacacagcaaaacaaacacaaaaggagacaagaaacaagaaaacaagcaacgaagacgcgaaaaacaagacaaacaaaccgagaacagagaccacgagaagacgaaagaggagaaaaaaccgaacaaaacgagagcagagagaagaacaggcaacggaccgaacgcttcggcaccagaaccaaggaagcaagaaagcaagacaagacgagaacaagcgggaaaccaaggatagagaacgaaaccacgagtcagaaaggacagaagacagagagagagcgaggacacatggcgagaaagaacaagaagcgggaagacgaccggaagaaggtaaaggaagcagaagatagcgaagcgagagctaattaacggaggacgacagacacaaacacacgcccgggcaccgcgcgggggn

SEQ ID NO: 327189 - DNA, 1445 bp, Homo sapiens
gattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggagttgtcaggggagtgtccattggcagcacctgcctcctgagtgtctcccaggccatcaccatcagccccaggagctcaggtgggcagagcttaaagggaacgcccccaagcacgctggctcctgtgtgttcctcagctggctcctccctggtcaatatcattgttctcatgcacgtgaccggcaagtggagcaacaaaaataccacgaagacaaaagatctgggatactgttctgctgctgatcacgagggcaccagagagtcgctgacgcggcactgctgtccttccctgatgtgatctgcctggggctcatgctctggggcagcagctccatcgtttgcatcctgcacaggcacaagcggcgggtccagcacattcataggaccagcgtgtcccccacatcctcccctgagtccggagctaccaaaaccatcctcctggtgagcacgtttgtgtccttttacactctctcttcacctttcaagtttgtttggctcttttgaataatcccagtcagctggtggtgaacatctctgcaatgatcagtgcaggtttcccaactgtcagccgctttcttctcatgagtggagactcctgtgtatccaagctttgctttgcttagataagtaacacaaaaccccctaatcttatcagaaatatgtgaattggacatgtttgtacaatgtttatgtttcttcattgatctctagagacccataaacacggttatgaaacgaggcttgttagtgctgtgcttgccagcaggggccactgttttattctgtacctcctgatcccccctccaaccacaccgccctggagcagctctgtggaaaaagtggaatcagcttagaggttttggagaggaagatactgaaacgtaaacgatataagaaagtcacggtgcacaaatatacatacctcatttctgtgtcccttggagcagatgggggaatgtgcgcagatgcgaagctcttgctgtaatttatgtgacaaataataaaatatatgttttgtcggatccagaaatctcatgccttcagccaacatccataaactgacagtctaacttgttggcttgtaagtaaggtaaaaatctaaaactggccaggcgcggtgtcacgcctgtaatcccagcactttggagggccgaagcagacggattaactgaggtcgagaatttgagaccagcctgacaaacatggagaaacctcatctctactaaaaaa

SEQ ID NO: 327190 - DNA, 2014 bp, Homo sapiens
actgtgttgattcaaggtttaatggatttagggctgtgcaggatgtgctttgtttaaaatgtgtttgcaggcagtatgcttggtaaaagtcatcaccattctccagtctcaaataccaagggacacaatgcactgcagaaggccacagggacctctgccccagaaagcctgggtattgtccaaggtttctgcctgctgagacagcctgagatatggcctcatgggaagggaaagacctgactgtcccccagcccaacacccgtaaagagtctgtgctgaggaggattagtgaaagaggaagacctctttgcagttgagataagaggaaggcatctgtctcctgctcgtcctggcaatggaacgtctcgctgtaaaacctgattgtacattctatttactgagataggagaaaaccgccttatggctggaggtgagacatgctggcggcaatactgctctttactgcactgagatgtttgtgtaaagtcaaacataaacctggcctacatgcacattgaggcacagcacctttccttaaacttatttatgacacagagacctttgcttacgttttcctgctgaccctctccccaccattagcctgtagtcctgccacattcccctcactgagatggtagagagagtgatcaataaatactgagggaactcagagaccagtgccgatgcgggtcctccgtatgctgagcgccggtcctctgggcccagtgttctttctctatactttgtctctgtgtcttatttcttttctcagtctcttatcccagctgatgagaaatagccacaggtgtggagggactggccccccttcagggttttatgccttgggcttaggttgtaatttggcagggcagccttccaccctttggcacagagctgggtgttccaaagaccacaaggggttttaggccctggaccccggcatgttccaagactctttatattatgtcagactagcaagccctgcctcagcttttccccaacatggaacgctgttctaaaagcacccatgattcttttttttcttttttttcttttttttttttttcagatggaatggagtttcgctcttgttgctcaggctggagtgcaatggtgtgatctcggctcactgcaacctccgcctcccgggttcaagcgattctcctgcctcagcctctcgagtagctgagattacagagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggacagggtcttgctgtgttgttgaaattcatcttgatctcctgagctcaagagatcctcctcagtctcccaagtagctgagattacaggtgccaaccaccatacctaattattggcttttatttttaagatttttgcatatgtgtggccgggcttggtggctcacgcctgtaatcccagcactttgggaggccaaggtgggtggatcacgaggtcaggcgatcgagaccagcccggccaacatggtgaaaccccgtctctactaaaaatagaaaaattagccgggtgtggtggcatgggcctgtaatcccagctacttgggaggctgaagcaggaggatcacatgaacctgggaatcggaggttgcagtgagccaagatcaccactgcacatctgcctggtgacagagtgagactccatctcaaaaaaataaataaaataaaatgaaatatttgcatatgtgtgtccttaaggctaatatgagtctatgagt

SEQ ID NO: 327191 - DNA, 2189 bp, Homo sapiens
gattgacttctaaagactcttggtatgtgaggaagaaacctggaagaggaagaggaaagcaaaggagtcagggatggctcttcctcagggtctattgacattcagggatgtggccatagaattctctcaggaggagtggaaatgcctggaccctgctcagaggactctatacagggacgtgatgctggagaattataggaacctggtctccctggagttgtcaggggagtgtccattggcagcacctgcctcctgagtgtctcccaggccatcaccatcagccccaggagctcaggtgggcagagcttaaagggaacgcccccaagcacgctggctcctgtgtgttcctcagctggctcctccctggtcaatatcattgttctcatgcacgtgaccggcaagtggagcaacaaaaataccacgaagacaaaagatctgggatactgttctgctgctgatcacgagggcaccagagagtcgctgacgcggcactgctgtccttccctgatgtgatctgcctggggctcatgctctggggcagcagctccatcgtttgcatcctgcacaggcacaagcggcgggtccagcacattcataggaccagcgtgtcccccacatcctcccctgagtccggagctaccaaaaccatcctcctggagcaggaaaggacaaggagtccccgaagctgacactgagttcatggggttgagctgacagcggccaacaggctgtggtaaacgctaatgaaacgagccttgttagtgctgtgcttgccagcaggggtcactgtttccttctgtacctcctgatccctccctccacccacaccgcactgcagcagctctggggaaaaagtggaatcagcttagaagtttttgggaggaagacactgaaagtcctacttttttttttcagatgggatctcactctgtcggccaggctggaatgcaatggtgccaacttggctcagtgcaacctccccaccccgggctccaacaatcctcccatctcagcctctgaagtagctgggactacaggcgttatctcctgtccggggaagaggtgggcctctctccgtcgtgggaggagctctgaacttctccttcatccagggatgggccccagggacccaccagtggggctgggagaagcccccctcagcaggaagacagaggtgcctgggtggccgaggcctggaaggtctgcaccatggtgcacagaggccccggagctgggtgaggccagaaagctgctctggggtcagcggggaatgtgcctgctgaatctgtacctgagctacgtcttcacaaatggcctcagacctagagtgcagggagatcccctggcttttctgaagtggtggcaggtggtctcctgggtagcaggatctgggctgcttacttcccttacccagtgagggcccgcggggagctcttaagttgggcatcatggggctgcgtgatgtggctgctgtgcccacatcagagggtttttgtttcttttccaaagtcaagctgcactaatctagaccagggatccccacccctgggctgcagaccggtccccatgggtggcctgttaggaactggaccgcacagcaggaggtgagcagtgggtgagtgcgcgtgaccacctgagctctgccttctgtgagatcagcagcgccactgcatctcagaggaatgccaaccctactgtgaactgtgcatgcgagggatctgggttgcatgctctttatgagatcaaactaatgcctgatgatctcaggtggaacagtttaatcctgaaaccatccccccatctgtggaaaaactgccttccactaaaccagtccctggtgccaaaaacactgggaaccgctaatctagacagttctctgctaaggaagcacgtggttgagaagcatcagaatcgttcccacggaccatgctccggagtctcagcaggctcctgcagtgtgtttatccgtgcatcatgaaggaccctcatacggctgacgtgccttggctgatgcgaataacactgcagcaagcgtggcagtgcagatagctcttggaaatacccatttccttcagacgcatactcagaggtaggattgctggattgtttggtcattttgatttttaaaattaaaaagaattttaattctcatattgttttgagtaaaattaaattataacttgtaaggc

SEQ ID NO: 327192 - DNA, 1633 bp, Homo sapiens
actgtgttgattcaaggtttaatggatttagggctgtgcaggatgtgctttgtttaaaatgtgtttgcaggcagtatgcttggtaaaagtcatcaccattctccagtctcaaataccaagggacacaatgcactgcagaaggccacagggacctctgccccagaaagcctgggtattgtccaaggtttctgcctgctgagacagcctgagatatggcctcatgggaagggaaagacctgactgtcccccagcccaacacccgtaaagagtctgtgctgaggaggattagtgaaagaggaagacctctttgcagttgagataagaggaaggcatctgtctcctgctcgtcctggcaatggaacgtctcgctgtaaaacctgattgtacattctatttactgagataggagaaaaccgccttatggctggaggtgagacatgctggcggcaatactgctctttactgcactgagatgtttgtgtaaagtcaaacataaacctggcctacatgcacattgaggcacagcacctttccttaaacttatttatgacacagagacctttgcttacgttttcctgctgaccctctccccaccattagcctgtagtcctgccacattcccctcactgagatggtagagagagtgatcaataaatactgagggaactcagagaccagtgccgatgcgggtcctccgtatgctgagcgccggtcctctgggcccagtgttctttctctatactttgtctctgtgtcttatttcttttctcagtctcttatcccagctgatgagaaatagccacaggtgtggagggactggccccccttcagggttttatgccttgggcttaggttgtaatttggcagggcagccttccaccctttggcacagagctgggtgttccaaagaccacaaggggttttaggccctggaccccggcatgttccaagactctttatattatgtcagactagcaagccctgcctcagcttttccccaacatggaacgctgttctaaaagcacccatgattcttttttttcttttttttcttttttttttttttcagatggaatggagtttcgctcttgttgctcaggctggagtgcaatggtgtgatctcggctcactgcaacctccgcctcccgggttcaagcgattctcctgcctcagcctctcgagtagctgagattacagagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggatatctcttccaaatgcacgatgaaggagttcttgtcaacagcgcaaggcaacagagaagtgttccatgcagggacattgcaaatacatgaaagtcatcacaatggagat

SEQ ID NO: 327193 - DNA, 1631 bp, Homo sapiens
actgtgttgattcaaggtttaatggatttagggctgtgcaggatgtgctttgtttaaaatgtgtttgcaggcagtatgcttggtaaaagtcatcaccattctccagtctcaaataccaagggacacaatgcactgcagaaggccacagggacctctgccccagaaagcctgggtattgtccaaggtttctgcctgctgagacagcctgagatatggcctcatgggaagggaaagacctgactgtcccccagcccaacacccgtaaagagtctgtgctgaggaggattagtgaaagaggaagacctctttgcagttgagataagaggaaggcatctgtctcctgctcgtcctggcaatggaacgtctcgctgtaaaacctgattgtacattctatttactgagataggagaaaaccgccttatggctggaggtgagacatgctggcggcaatactgctctttactgcactgagatgtttgtgtaaagtcaaacataaacctggcctacatgcacattgaggcacagcacctttccttaaacttatttatgacacagagacctttgcttacgttttcctgctgaccctctccccaccattagcctgtagtcctgccacattcccctcactgagatggtagagagagtgatcaataaatactgagggaactcagagaccagtgccgatgcgggtcctccgtatgctgagcgccggtcctctgggcccagtgttctttctctatactttgtctctgtgtcttatttcttttctcagtctcttatcccagctgatgagaaatagccacaggtgtggagggactggccccccttcagggttttatgccttgggcttaggttgtaatttggcagggcagccttccaccctttggcacagagctgggtgttccaaagaccacaaggggttttaggccctggaccccggcatgttccaagactctttatattatgtcagactagcaagccctgcctcagcttttccccaacatggaacgctgttctaaaagcacccatgattcttttttttcttttttttcttttttttttttttcagatggaatggagtttcgctcttgttgctcaggctggagtgcaatggtgtgatctcggctcactgcaacctccgcctcccgggttcaagcgattctcctgcctcagcctctcgagtagctgagattacagagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctggaaacggggtttcaccgtgtgaaccaggatggtctcgatctcctgacctcgtgatcctcctgcctcagcctcccaaagtgctgggattacaggtgtgaaccaccatgcc

SEQ ID NO: 327194 - DNA, 1660 bp, Homo sapiens
ttgagccacagtgcccgaccaagattcctccattctataacccttgaatgggactgttgtgtgagagggaggattgaaatgaactgtccgaatgtgatttatctgttgctcattctcttcctggcaggagcaggaaaggacaaggagtccccgaagctgacactgagttcatggggttgagctgacagcggccaacaggctgtggtaaacgctaatgaaacgagccttgttagtgctgtgcttgccagcaggggtcactgtttccttctgtacctcctgatccctccctccacccacaccgcactgcagcagctctggggaaaaagtggaatcagcttagaagtttttgggaggaagacactgaaagtcctacttttttttttcagatgggatctcactctgtcggccaggctggaatgcaatggtgccaacttggctcagtgcaacctccccaccccgggctccaacaatcctcccatctcagcctctgaagtagctgggactacaggcgttatctcctgtccggggaagaggtgggcctctctccgtcgtgggaggagctctgaacttctccttcatccagggatgggccccagggacccaccagtggggctgggagaagcccccctcagcaggaagacagaggtgcctgggtggccgaggcctggaaggtctgcaccatggtgcacagaggccccggagctgggtgaggccagaaagctgctctggggtcagcggggaatgtgcctgctgaatctgtacctgagctacgtcttcacaaatggcctcagacctagagtgcagggagatcccctggcttttctgaagtggtggcaggtggtctcctgggtagcaggatctgggctgcttacttcccttacccagtgagggcccgcggggagctcttaagttgggcatcatggggctgcgtgatgtggctgctgtgcccacatcagagggtttttgtttcttttccaaagtcaagctgcactaatctagaccagggatccccacccctgggctgcagaccggtccccatgggtggcctgttaggaactggaccgcacagcaggaggtgagcagtgggtgagtgcgcgtgaccacctgagctctgccttctgtgagatcagcagcgccactgcatctcagaggaatgccaaccctactgtgaactgtgcatgcgagggatctgggttgcatgctctttatgagatcaaactaatgcctgatgatctcaggtggaacagtttaatcctgaaaccatccccccatctgtggaaaaactgccttccactaaaccagtccctggtgccaaaaacactgggaaccgctaatctagacagttctctgctaaggaagcacgtggttgagaagcatcagaatcgttcccacggaccatgctccggagtctcagcaggctcctgcagtgtgtttatccgtgcatcatgaaggaccctcatacggctgacgtgccttggctgatgcgaataacactgcagcaagcgtggcagtgcagatagctcttggaaatacccatttccttcagacgcatactcagaggtaggattgctggattgtttggtcattttgatttttaaaattaaaaagaattttaattctcatattgttttgagtaaaattaaattataacttgtaaggc

SEQ ID NO: 327195 - DNA, 1213 bp, Homo sapiens
ggatagcgtggagtgacggtgccaccgcggcgcatggagtttcgctcttgttgctcaggctggagtgcaatggtgtgatctcggctcactgcaacctccgcctcccgggttcaagcgattctcctgcctcagcctctcgagtagctgagattacagagtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggagagcaaaggagtcagggatggctttttctcagggtctattgacattcagggatgtggccatagaattctctcaggaggagtggaaatgcctggaccctgctcagaggactctatacagggacgtgatgctggagaattataggaacctggtctccctgggtgaggataacttccctccagaagtgggaatgtgcccttgtgtatctttgtattttctcttgtttttagatacagtgtcttgctctgtcacccagggtagagtgcaatggtgtgatcatggctcactgcagtcttgaattccttggctcaagtgattgtcccacctcagcctcccccggtagctggtacaggtgcatgccaccatgtttgggcaaattttttagtttgttttctttccagacagggtcttgctgtgttgttgaaattcatcttgatctcctgagctcaagagatcctcctcagtctcccaagtagctgagattacaggtgccaaccaccatacctaattattggcttttatttttaagatttttgcatatgtgtggccgggcttggtggctcacgcctgtaatcccagcactttgggaggccaaggtgggtggatcacgaggtcaggcgatcgagaccagcccggccaacatggtgaaaccccgtctctactaaaaatagaaaaattagccgggtgtggtggcatgggcctgtaatcccagctacttgggaggctgaagcaggaggatcacatgaacctgggaatcggaggttgcagtgagccaagatcaccactgcacatctgcctggtgacagagtgagactccatctcaaaaaaataaataaaataaaatgaaatatttgcatatgtgtgtccttaaggctaatatgagtctatgagt

SEQ ID NO: 327196 - DNA, 821 bp, Homo sapiens
gtggcggtgaatagataagcatcgtgactggggaagctcaggtgagcaccacctgagggagagggtctggcagtgaataaataagcagtgtgactgggaaattgtgaagctcaggtgagcgccaccacctcctgggttgctttagtgtccagcagctgcctagaactatgttgaatgaagagctctctgggttctggaagtgggacagctttgggtggggcagtgttaccaccgtcagcctggcttgggtctgcagggtccagggcctcggtcactttgcttctctctccacagctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggacctggccgcccacctgggttcatctgacactgccttccctctttgccctgtggtactgctgtctgccaggtctgtgctgccttgggcatggaataaacattctcagccctgcttgctctgcctgtcttctatctttgtggacctggtttgcatttggggtgt

SEQ ID NO: 327197 - DNA, 1788 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327198 - DNA, 3217 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgaaaaaaaaaaaaaaaaaaaaaaaaaaaaaaaaacaaaaacaagaaaaaaaaaaaaaaagaaaacacaaacaaaacagaacgaaaggggggcgcccaacacgaacctacacccagcgaggcacacagaactacaccgcgccacacagccgcaccaaaaagagcgaccacacacacggcgcaccacaaaacacacaccaccgagcgcgccgtcccaccacacacgcagcagagacacacaccgcacgcgaacgctactaagaagacaacccaccacatcacggacgcgagcgaccaacgagtcggacagcaacacacagcagacagtcacagccagccgaagcgaaaacaacaagcccagccgcgggaactgcgggcaaaacacccggaacagcgcgccgagcaagcatgtccagcggagcattcagaacatatccggcggcgcataagcaacacccgacgcaacgaccgcacagcgaccgcaacccagccgacgcgacagcgacagcaggcacgcaacagacagcgcagaccaagcgacgccacacgcggcttgtgcggacgcgtggtaagctcagcgcaagcgcagacagccccgcggcgagcaaccagcaacgcagacaatagaacatgaagtacagactacaccagcgagcaactagcagaaggcgacgcgatgcagacgacagcaagcgcagtcccagccagtaacgcaacgcagagagaacaggaccagaagacgaacaccgactgagacggacgtcgcacgacacaagagagaaagcgagaccaggcgagcgaacgcaccacgcagacaacggcagcagagcccgcggagagtgggcggcgggagcggccggaggggaggcgagcaggggggaggcacgaggcaacagcgggggccggggggcggcgggcgcgagagggagcgggaggcatgcgagaggagcagaggcgaacgcgagagccgagagaaagcacaggccggacacgccagcgaagcccacgcccgctccgccggagacgccggacgcccggcggagcccgacacggacaacggcacagggaaagacggcggccggcgcgtacggcagaaagcagaagcgccagagacagcgaacagaccagcgacgagaacacgccgacaggccgacgaggcggagaggagagagcccacgaacaaagaccggcacaaacgaaacacagacacaaacaagagcacaaaaggcggcggcgcaccgaggcgatggagcgggcagggctaagaccgactgaggaggcggcacacacacgacgcacgcgcacgcacacgccgcgcgacgaggccgagcacacgagcccagaacagcagacgacgacagccagcaaaagacaacagacaagaacaggggaacacaccacagcgacacgagctgagacacacgcgacagat

SEQ ID NO: 327199 - DNA, 3416 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagctagagaccgcacaccagctaactggacattgctaggagaagctgccgttcccatccctaccccagtgggacctggaatccaactcggcagtttccacgcccccagtcatctcccgtggggccagcaggacccaggttggggggtggggccatgtcaggaagctcagccatgcagggccttgaatggcagatcttgcagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgaaaaaaaaaaaaaaaaaaaaaaaaaaaaaaaaacaaaaacaagaaaaaaaaaaaaaaagaaaacacaaacaaaacagaacgaaaggggggcgcccaacacgaacctacacccagcgaggcacacagaactacaccgcgccacacagccgcaccaaaaagagcgaccacacacacggcgcaccacaaaacacacaccaccgagcgcgccgtcccaccacacacgcagcagagacacacaccgcacgcgaacgctactaagaagacaacccaccacatcacggacgcgagcgaccaacgagtcggacagcaacacacagcagacagtcacagccagccgaagcgaaaacaacaagcccagccgcgggaactgcgggcaaaacacccggaacagcgcgccgagcaagcatgtccagcggagcattcagaacatatccggcggcgcataagcaacacccgacgcaacgaccgcacagcgaccgcaacccagccgacgcgacagcgacagcaggcacgcaacagacagcgcagaccaagcgacgccacacgcggcttgtgcggacgcgtggtaagctcagcgcaagcgcagacagccccgcggcgagcaaccagcaacgcagacaatagaacatgaagtacagactacaccagcgagcaactagcagaaggcgacgcgatgcagacgacagcaagcgcagtcccagccagtaacgcaacgcagagagaacaggaccagaagacgaacaccgactgagacggacgtcgcacgacacaagagagaaagcgagaccaggcgagcgaacgcaccacgcagacaacggcagcagagcccgcggagagtgggcggcgggagcggccggaggggaggcgagcaggggggaggcacgaggcaacagcgggggccggggggcggcgggcgcgagagggagcgggaggcatgcgagaggagcagaggcgaacgcgagagccgagagaaagcacaggccggacacgccagcgaagcccacgcccgctccgccggagacgccggacgcccggcggagcccgacacggacaacggcacagggaaagacggcggccggcgcgtacggcagaaagcagaagcgccagagacagcgaacagaccagcgacgagaacacgccgacaggccgacgaggcggagaggagagagcccacgaacaaagaccggcacaaacgaaacacagacacaaacaagagcacaaaaggcggcggcgcaccgaggcgatggagcgggcagggctaagaccgactgaggaggcggcacacacacgacgcacgcgcacgcacacgccgcgcgacgaggccgagcacacgagcccagaacagcagacgacgacagccagcaaaagacaacagacaagaacaggggaacacaccacagcgacacgagctgagacacacgcgacagat

SEQ ID NO: 327200 - DNA, 3155 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaaggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgaaaaaaaaaaaaaaaaaaaaaaaaaaaaaaaaacaaaaacaagaaaaaaaaaaaaaaagaaaacacaaacaaaacagaacgaaaggggggcgcccaacacgaacctacacccagcgaggcacacagaactacaccgcgccacacagccgcaccaaaaagagcgaccacacacacggcgcaccacaaaacacacaccaccgagcgcgccgtcccaccacacacgcagcagagacacacaccgcacgcgaacgctactaagaagacaacccaccacatcacggacgcgagcgaccaacgagtcggacagcaacacacagcagacagtcacagccagccgaagcgaaaacaacaagcccagccgcgggaactgcgggcaaaacacccggaacagcgcgccgagcaagcatgtccagcggagcattcagaacatatccggcggcgcataagcaacacccgacgcaacgaccgcacagcgaccgcaacccagccgacgcgacagcgacagcaggcacgcaacagacagcgcagaccaagcgacgccacacgcggcttgtgcggacgcgtggtaagctcagcgcaagcgcagacagccccgcggcgagcaaccagcaacgcagacaatagaacatgaagtacagactacaccagcgagcaactagcagaaggcgacgcgatgcagacgacagcaagcgcagtcccagccagtaacgcaacgcagagagaacaggaccagaagacgaacaccgactgagacggacgtcgcacgacacaagagagaaagcgagaccaggcgagcgaacgcaccacgcagacaacggcagcagagcccgcggagagtgggcggcgggagcggccggaggggaggcgagcaggggggaggcacgaggcaacagcgggggccggggggcggcgggcgcgagagggagcgggaggcatgcgagaggagcagaggcgaacgcgagagccgagagaaagcacaggccggacacgccagcgaagcccacgcccgctccgccggagacgccggacgcccggcggagcccgacacggacaacggcacagggaaagacggcggccggcgcgtacggcagaaagcagaagcgccagagacagcgaacagaccagcgacgagaacacgccgacaggccgacgaggcggagaggagagagcccacgaacaaagaccggcacaaacgaaacacagacacaaacaagagcacaaaaggcggcggcgcaccgaggcgatggagcgggcagggctaagaccgactgaggaggcggcacacacacgacgcacgcgcacgcacacgccgcgcgacgaggccgagcacacgagcccagaacagcagacgacgacagccagcaaaagacaacagacaagaacaggggaacacaccacagcgacacgagctgagacacacgcgacagat

SEQ ID NO: 327201 - DNA, 1086 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctg

SEQ ID NO: 327202 - DNA, 1137 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctgcttgctctgcctgtcttctatctttgtggacctggtttgcatttggggtgt

SEQ ID NO: 327203 - DNA, 1605 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccgggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327204 - DNA, 1938 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggtgcagacccctgacaagtcagtgagcccccctctgcctgtgcctttcttcttccttttggcactctgggtggcggcccctccccaccctggctgccctcctctccacttcgccctcctgtcctctcacctacccgcccagcagggctcctggcctcacccttacccactccctcccatcactgtaacccaaacccacatgcaccaaatcctgggaggggctgcccccaccgcccacccccagtgtggggttctgagccacaccctcccacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327205 - DNA, 1846 bp, Homo sapiens
atcaggcccactgtggccccacgcccgctgcccgctgctgctcagtctgtgctgcgccccagcccggcggaaccgtgcggcagcgccccctggcggccggggtggggctgcaggcacagggcccctcccgaggctgtggcgccttgcagggcaccgccctggggaggggtctctgaatgacgccgcgccccctgctggcggctgggggttgggttgtggtgtcgggccagctgagccccagacactcagtgccgccttgtccccggctgttctgacccctccccgtctttcttcctctcctgtgtctgtccctttgtccctttatctgtctgtctgtcttatttccttcacaggtgcagacccctgacaagtcagtgagcccccctctgcctgtgcctttcttcttccttttggcactctgggtggcggcccctccccaccctggctgccctcctctccacttcgccctcctgtcctctcacctacccgcccagcagggctcctggcctcacccttacccactccctcccatcactgtaacccaaacccacatgcaccaaatcctgggaggggctgcccccaccgcccacccccagtgtggggttctgagccacaccctcccacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327206 - DNA, 1110 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgccccctggccgcccacctgggttcatctgacactgccttccctctttgccctgtggtactgctgtctgccaggtctgtgctgccttgggcatggaataaacattctcagccctgcttgctctgcctgtcttctatctttgtggacctggtttgcatttggggtgt

SEQ ID NO: 327207 - DNA, 1366 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaaggtacagggacgggcaccagcccctctcccacctcctgcctcttccattccagctactgccctgtgtctactcctgaggctcccagctggggctctcaattctccctcccttccttccttccttccttccttccttccttccttccttccttccttccttcccttcctccttccttccttctttcatttcttccctccctccttccttccctcctccctccctgcctcccttccatctctccttccttccacttcttcctccctctctctctgcccctcagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctg

SEQ ID NO: 327208 - DNA, 2436 bp, Homo sapiens
tccatcagccgctgcttgctggcatctgggaccagcggtcggagcggctgtccattctgctgcggggcgctgtcagcgggcgggggcgccccaaagggccgggccgtcttgttgagggagacgctgggtgcaaaggtgtaccgcggagggtccgcggcgggggcggaggcctgggcagagacacagccgggcagggcggggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgaaaaaaaaaaaaaaaaaaaaaaaaaaaaaaaaacaaaaacaagaaaaaaaaaaaaaaagaaaacacaaacaaaacagaacgaaaggggggcgcccaacacgaacctacacccagcgaggcacacagaactacaccgcgccacacagccgcaccaaaaagagcgaccacacacacggcgcaccacaaaacacacaccaccgagcgcgccgtcccaccacacacgcagcagagacacacaccgcacgcgaacgctactaagaagacaacccaccacatcacggacgcgagcgaccaacgagtcggacagcaacacacagcagacagtcacagccagccgaagcgaaaacaacaagcccagccgcgggaactgcgggcaaaacacccggaacagcgcgccgagcaagcatgtccagcggagcattcagaacatatccggcggcgcataagcaacacccgacgcaacgaccgcacagcgaccgcaacccagccgacgcgacagcgacagcaggcacgcaacagacagcgcagaccaagcgacgccacacgcggcttgtgcggacgcgtggtaagctcagcgcaagcgcagacagccccgcggcgagcaaccagcaacgcagacaatagaacatgaagtacagactacaccagcgagcaactagcagaaggcgacgcgatgcagacgacagcaagcgcagtcccagccagtaacgcaacgcagagagaacaggaccagaagacgaacaccgactgagacggacgtcgcacgacacaagagagaaagcgagaccaggcgagcgaacgcaccacgcagacaacggcagcagagcccgcggagagtgggcggcgggagcggccggaggggaggcgagcaggggggaggcacgaggcaacagcgggggccggggggcggcgggcgcgagagggagcgggaggcatgcgagaggagcagaggcgaacgcgagagccgagagaaagcacaggccggacacgccagcgaagcccacgcccgctccgccggagacgccggacgcccggcggagcccgacacggacaacggcacagggaaagacggcggccggcgcgtacggcagaaagcagaagcgccagagacagcgaacagaccagcgacgagaacacgccgacaggccgacgaggcggagaggagagagcccacgaacaaagaccggcacaaacgaaacacagacacaaacaagagcacaaaaggcggcggcgcaccgaggcgatggagcgggcagggctaagaccgactgaggaggcggcacacacacgacgcacgcgcacgcacacgccgcgcgacgaggccgagcacacgagcccagaacagcagacgacgacagccagcaaaagacaacagacaagaacaggggaacacaccacagcgacacgagctgagacacacgcgacagat

SEQ ID NO: 327209 - DNA, 967 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaagacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctg

SEQ ID NO: 327210 - DNA, 440 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgccccgcagcagaatgggtgcagaccccttgacacacagccgctccgaccgctggtcccagat

SEQ ID NO: 327211 - DNA, 1861 bp, Homo sapiens
ggggaggccgcgccagtttagtccctcggcccacccctggttgcaaagaacctcaagcctggattcaggcacccctcaccgttccagtcccaaggggaggggggctgctcctgtctttccaaagtgaggtccgccagccagcagcccaggccagcctgacaaaatacctgcctcctatggcttgggcgtgctcaggggctgcccgtgcctgcctggcccctgtccaaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327212 - DNA, 1669 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaagacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327213 - DNA, 1820 bp, Homo sapiens
gtggcggtgaatagataagcatcgtgactggggaagctcaggtgagcaccacctgagggagagggtctggcagtgaataaataagcagtgtgactgggaaattgtgaagctcaggtgagcgccaccacctcctgggttgctttagtgtccagcagctgcctagaactatgttgaatgaagagctctctgggttctggaagtgggacagctttgggtggggcagtgttaccaccgtcagcctggcttgggtctgcagggtccagggcctcggtcactttgcttctctctccacagctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327214 - DNA, 2265 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaagtacgaggctggccgggacatccgggcggtgggcggtgtgggcttggacggccaggcctgctcgccctcctggcacattctcggtaccccaatccctggccgggagtggagggcagaaaccggagctaaggcgggtctagggccctggagttgagccaggggctgctgcacggtcctggcaccacgcatgtccgcctgtctgtccgcctgtctgtccgcctgctgcctcccgccgccggcgctgcgtgctcgcccgcactcggtcagccctcggtcctgcgtggactgagatcgccactcccaaatgggccccttgaaacctgagtcgtcctctccccgtagcctccaaatagatgtagggggtggggtgggggtggggggctggagctgccgctgtcctctgctgcaggcgccccacttccacccaggcccccaccttaccctgcccgcccgccctgcccggctgtgtctctgcccagcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327215 - DNA, 1857 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcgccccacttccacccaggcccccaccttaccctgcccgcccgccctgcccggctgtgtctctgcccagcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctg

SEQ ID NO: 327216 - DNA, 1083 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagggaaaagtatgtcctggagctgcagagcccacgctacacccgcctccgggactggcaccaccagcgctctgcccacgtgctcaacgtgcagtcgtagccggctttcagcggtgcttttggtcctcttatgtctcctgcagggaccccttatgtccagtttgtactaacaccctttggcctgactgagcccgtggctgccggcgccacggtactgaactgactccttgcgggacgcgtgcgtaggccgagaacttccctaaagaacaacaaagcaacaaccgagtggacaaaagagcgactaaggaagacaatagtgagagacagcatctgtcttctatataggga

SEQ ID NO: 327217 - DNA, 1059 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgccccctggccgcccacctgggttcatctgacactgccttccctctttgccctgtggtactgctgtctgccaggtctgtgctgccttgggcatggaataaacattctcagccctg

SEQ ID NO: 327218 - DNA, 3036 bp, Homo sapiens
cttttttttaagcagggctgagaatgtttattccatgcccaaggcagcacagacctggcagacagcagtaccacagggcaaagagggagggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaagacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaaggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgaaaaaaaaaaaaaaaaaaaaaaaaaaaaaaaaacaaaaacaagaaaaaaaaaaaaaaagaaaacacaaacaaaacagaacgaaaggggggcgcccaacacgaacctacacccagcgaggcacacagaactacaccgcgccacacagccgcaccaaaaagagcgaccacacacacggcgcaccacaaaacacacaccaccgagcgcgccgtcccaccacacacgcagcagagacacacaccgcacgcgaacgctactaagaagacaacccaccacatcacggacgcgagcgaccaacgagtcggacagcaacacacagcagacagtcacagccagccgaagcgaaaacaacaagcccagccgcgggaactgcgggcaaaacacccggaacagcgcgccgagcaagcatgtccagcggagcattcagaacatatccggcggcgcataagcaacacccgacgcaacgaccgcacagcgaccgcaacccagccgacgcgacagcgacagcaggcacgcaacagacagcgcagaccaagcgacgccacacgcggcttgtgcggacgcgtggtaagctcagcgcaagcgcagacagccccgcggcgagcaaccagcaacgcagacaatagaacatgaagtacagactacaccagcgagcaactagcagaaggcgacgcgatgcagacgacagcaagcgcagtcccagccagtaacgcaacgcagagagaacaggaccagaagacgaacaccgactgagacggacgtcgcacgacacaagagagaaagcgagaccaggcgagcgaacgcaccacgcagacaacggcagcagagcccgcggagagtgggcggcgggagcggccggaggggaggcgagcaggggggaggcacgaggcaacagcgggggccggggggcggcgggcgcgagagggagcgggaggcatgcgagaggagcagaggcgaacgcgagagccgagagaaagcacaggccggacacgccagcgaagcccacgcccgctccgccggagacgccggacgcccggcggagcccgacacggacaacggcacagggaaagacggcggccggcgcgtacggcagaaagcagaagcgccagagacagcgaacagaccagcgacgagaacacgccgacaggccgacgaggcggagaggagagagcccacgaacaaagaccggcacaaacgaaacacagacacaaacaagagcacaaaaggcggcggcgcaccgaggcgatggagcgggcagggctaagaccgactgaggaggcggcacacacacgacgcacgcgcacgcacacgccgcgcgacgaggccgagcacacgagcccagaacagcagacgacgacagccagcaaaagacaacagacaagaacaggggaacacaccacagcgacacgagctgagacacacgcgacagat

SEQ ID NO: 327219 - DNA, 2258 bp, Homo sapiens
gctctggcccagaaatcaggccacgggagtccaggcgcctcaggctaggggccaccgggcagctgtgggcagaagggctcacacatgagagaaggcatggctcttgcgagaggcctgtcttcttggagtaaaggtctttccttaccaggttgatctgacatatgacagacgaacggtgtcatgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgaaaaaaaaaaaaaaaaaaaaaaaaaaaaaaaaacaaaaacaagaaaaaaaaaaaaaaagaaaacacaaacaaaacagaacgaaaggggggcgcccaacacgaacctacacccagcgaggcacacagaactacaccgcgccacacagccgcaccaaaaagagcgaccacacacacggcgcaccacaaaacacacaccaccgagcgcgccgtcccaccacacacgcagcagagacacacaccgcacgcgaacgctactaagaagacaacccaccacatcacggacgcgagcgaccaacgagtcggacagcaacacacagcagacagtcacagccagccgaagcgaaaacaacaagcccagccgcgggaactgcgggcaaaacacccggaacagcgcgccgagcaagcatgtccagcggagcattcagaacatatccggcggcgcataagcaacacccgacgcaacgaccgcacagcgaccgcaacccagccgacgcgacagcgacagcaggcacgcaacagacagcgcagaccaagcgacgccacacgcggcttgtgcggacgcgtggtaagctcagcgcaagcgcagacagccccgcggcgagcaaccagcaacgcagacaatagaacatgaagtacagactacaccagcgagcaactagcagaaggcgacgcgatgcagacgacagcaagcgcagtcccagccagtaacgcaacgcagagagaacaggaccagaagacgaacaccgactgagacggacgtcgcacgacacaagagagaaagcgagaccaggcgagcgaacgcaccacgcagacaacggcagcagagcccgcggagagtgggcggcgggagcggccggaggggaggcgagcaggggggaggcacgaggcaacagcgggggccggggggcggcgggcgcgagagggagcgggaggcatgcgagaggagcagaggcgaacgcgagagccgagagaaagcacaggccggacacgccagcgaagcccacgcccgctccgccggagacgccggacgcccggcggagcccgacacggacaacggcacagggaaagacggcggccggcgcgtacggcagaaagcagaagcgccagagacagcgaacagaccagcgacgagaacacgccgacaggccgacgaggcggagaggagagagcccacgaacaaagaccggcacaaacgaaacacagacacaaacaagagcacaaaaggcggcggcgcaccgaggcgatggagcgggcagggctaagaccgactgaggaggcggcacacacacgacgcacgcgcacgcacacgccgcgcgacgaggccgagcacacgagcccagaacagcagacgacgacagccagcaaaagacaacagacaagaacaggggaacacaccacagcgacacgagctgagacacacgcgacagat

SEQ ID NO: 327220 - DNA, 179 bp, Homo sapiens
acagaggactggcggccgcggccggggacaggccagtcgcgttccttccgcatccttgcccacctcacaggcaccgagttcagtaagtgccagcccagggcagggggtactttcctcgcccccagcccaggcgtgatccctgaccctgtgtcttttttggtcaatgcctgcctctgccc

SEQ ID NO: 327221 - DNA, 1342 bp, Homo sapiens
catctccagaagtcatatttagtttttctttatatcattcatttctcttttaattatatacatgtttttctttaaatacttaaacatggttataacagctgtgttttaagctccttgtctgttaattccatcatctgtcatttttgcatctgtttttattgactaactttcttcctcatcatggtcacatatccttgcttcttcccatatttagtaaagtttagttggatgctggattgttttaatttagcattttggagtgactgcttttgcacttgcctttaaaagtattggacttcgttttgatagttgaattacttgcaaatcagcttgatcattctgagacttgtttttaacttttgtcgaaaaggctatgctacttcaagtataataaaacctagttttagttttatcctataactaaggcatgtgttcaatttgaatgtctccaaccctgtgtgaactctgaaaattgttcagctcccaatttcgcagtaatttttttttgttcagccttgcagtctcatcctactcaagtgtggctctgtatccaacaacagtcttggagatctcatgaagatttctgaaacttttgctctgcaggataccttcctttgtggttatgtgccctgaaaactccagcctccgtgtcttcaattcagtgaaactactactctgcttggattcccctcttatacaatggtctaccaagtgactgcaaacagaaatctaagggaatttcaggagtcacctcatttattttcctttttttcagggattatagtagtactataccacctgtcagccaatgtgtgagaatggtggtttcatacattttctccaattctttcttgttacaggagcctccattacttttcaaacagtaatgcagttgcagttgcctctccttttcttcattatgtgtttatctctggcagtttgagccaagagagggcacggagaagtacaatgactagagagcacttctgttgaggctcattcattgacccctaccccagtgctttatgaatgtgtgctgcagatgtcatacagcatcacagcttcttctctaatttatgagccataatttttttttttgtatttttattgtattacctgcttggttgcaagaggatgatgaggaggactactataggataaatttgtttttatagagcaatttctcatgggtcacgagggatagtactccattttcctcactgatatcggcttgatcatctgagtcagtgggctcattgtggaaacatatggaatcctttatgctttttctcaggctgcttctgttacatgaaataaagccagagttgattgtgaaaaaaag

SEQ ID NO: 327222 - DNA, 1928 bp, Homo sapiens
agcggctcccatcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggtggtcgggagagcggcggcagcgagaggcgagccagcggcgacgaatgaagaactttttcacttactgcaggattttcagcttcagcaagcaggttctcatggagaactgttattgaagagagatccatttggtgggatataattaaaaaaaatgaatcaaaagaaaatctctaaatgcagattccagaaaaattacagcacatctcagtgaatttgcaagtggatcatccttccttgtgggttagcaggcagttataagattgcaaaatgggtctccggattcactttgttgttgacccacatggttggtgctgcatgggtttgattgtctttgtttggttatacaatattgttttaattcccaaaattgtcctctttcctcactatgaagaaggacatattccaggcatattaataataatattctatggcatttccatattctgtctggttgccttagtgagggcctccataactgatccaggaagactccctgagaaccccaagatcccacatggagaacgggagttctgggaattatgtaacaagtgtactttgatgagaccaaagcgttcccatcactgtagccgctgcggccactgtgtgaggagaatggatcatcactgtccatggattaacaattgtgttggtgaagataatcattggctctttctgcagttgtgtttctacactgaacttcttacttgctacgcactgatgttttctttctgccactattactattttcttccactaaaaaagcgtaatttggacctctttgtttttagacatgaattggccataatgagactagcagcctttatgggcattactatgttagttggaataactggactcttttacactcaactaattggcatcatcacaccttgcagtctcatcctactcaagtgtggctctgtatccaacaacagtcttggagatctcatgaagatttctgaaacttttgctctgcaggataccttcctttgtggttatgtgccctgaaaactccagcctccgtgtcttcaattcagtgaaactactactctgcttggattcccctcttatacaatggtctaccaagtgactgcaaacagaaatctaagggaatttcaggagtcacctcatttattttcctttttttcagggattatagtagtactataccacctgtcagccaatgtgtgagaatggtggtttcatacattttctccaattctttcttgttacaggagcctccattacttttcaaacagtaatgcagttgcagttgcctctccttttcttcattatgtgtttatctctggcagtttgagccaagagagggcacggagaagtacaatgactagagagcacttctgttgaggctcattcattgacccctaccccagtgctttatgaatgtgtgctgcagatgtcatacagcatcacagcttcttctctaatttatgagccataatttttttttttgtatttttattgtattacctgcttggttgcaagaggatgatgaggaggactactataggataaatttgtttttatagagcaatttctcatgggtcacgagggatagtactccattttcctcactgatatcggcttgatcatctgagtcagtgggctcattgtggaaacatatggaatcctttatgctttttctcaggctgcttctgttacatgaaataaagccagagttgattgtgaaaaaaag

SEQ ID NO: 327223 - DNA, 1820 bp, Homo sapiens
agcggctcccatcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggtggtcgggagagcggcggcagcgagaggcgagccagcggcgacgaatgaagaactttttcacttactgcaggattttcagcttcagcaagcagttagcattttggaggcgctgctttgccagtcaatttctcatttaagcgtgacagcaactgtgttctcatggagaactgttattgaagagagatccatttggtgggatataattaaaaaaaatgaatcaaaagaaaatctctaaatgcagattccagaaaaattacagcacatctcagtgaatttgcaagtgaaggacatattccaggcatattaataataatattctatggcatttccatattctgtctggttgccttagtgagggcctccataactgatccaggaagactccctgagaaccccaagatcccacatggagaacgggagttctgggaattatgtaacaagtgtactttgatgagaccaaagcgttcccatcactgtagccgctgcggccactgtgtgaggagaatggatcatcactgtccatggattaacaattgtgttggtgaagataatcattggctctttctgcagttgtgtttctacactgaacttcttacttgctacgcactgatgttttctttctgccactattactattttcttccactaaaaaagcgtaatttggacctctttgtttttagacatgaattggccataatgagactagcagcctttatgggcattactatgttagttggaataactggactcttttacactcaactaattggcatcatcacaccttgcagtctcatcctactcaagtgtggctctgtatccaacaacagtcttggagatctcatgaagatttctgaaacttttgctctgcaggataccttcctttgtggttatgtgccctgaaaactccagcctccgtgtcttcaattcagtgaaactactactctgcttggattcccctcttatacaatggtctaccaagtgactgcaaacagaaatctaagggaatttcaggagtcacctcatttattttcctttttttcagggattatagtagtactataccacctgtcagccaatgtgtgagaatggtggtttcatacattttctccaattctttcttgttacaggagcctccattacttttcaaacagtaatgcagttgcagttgcctctccttttcttcattatgtgtttatctctggcagtttgagccaagagagggcacggagaagtacaatgactagagagcacttctgttgaggctcattcattgacccctaccccagtgctttatgaatgtgtgctgcagatgtcatacagcatcacagcttcttctctaatttatgagccataatttttttttttgtatttttattgtattacctgcttggttgcaagaggatgatgaggaggactactataggataaatttgtttttatagagcaatttctcatgggtcacgagggatagtactccattttcctcactgatatcggcttgatcatctgagtcagtgggctcattgtggaaacatatggaatcctttatgctttttctcaggctgcttctgttacatgaaataaagccagagttgattgtgaaaaaaag

SEQ ID NO: 327224 - DNA, 1080 bp, Homo sapiens
agctcggtaccccccccaatggaatccctcgtagagaggaggcctcagcctcagtgcatatttgttgcattacactaataaggagttgtttgaactacagtcgtctttctgtttaagtatagttctacttgtaaatttcgtgtagggatgattcctgacacaaggaatcatcacatctattacatgtcgaggaatactcactttcactctgtttgcagcttgctttatgtatttgagagtgctcttgttagccttgcagtctcatcctactcaagtgtggctctgtatccaacaacagtcttggagatctcatgaagatttctgaaacttttgctctgcaggataccttcctttgtggttatgtgccctgaaaactccagcctccgtgtcttcaattcagtgaaactactactctgcttggattcccctcttatacaatggtctaccaagtgactgcaaacagaaatctaagggaatttcaggagtcacctcatttattttcctttttttcagggattatagtagtactataccacctgtcagccaatgtgtgagaatggtggtttcatacattttctccaattctttcttgttacaggagcctccattacttttcaaacagtaatgcagttgcagttgcctctccttttcttcattatgtgtttatctctggcagtttgagccaagagagggcacggagaagtacaatgactagagagcacttctgttgaggctcattcattgacccctaccccagtgctttatgaatgtgtgctgcagatgtcatacagcatcacagcttcttctctaatttatgagccataatttttttttttgtatttttattgtattacctgcttggttgcaagaggatgatgaggaggactactataggataaatttgtttttatagagcaatttctcatgggtcacgagggatagtactccattttcctcactgatatcggcttgatcatctgagtcagtgggctcattgtggaaacatatggaatcctttatgctttttctcaggctgcttctgttacatgaaataaagccagagttgattgtgaaaaaaag

SEQ ID NO: 327225 - DNA, 1241 bp, Homo sapiens
agcggctcccatcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggtggtcgggagagcggcggcagcgagaggcgagccagcggcgacgaatgaagaactttttcacttactgcaggattttcagcttcagcaagcaggttctcatggagaactgttattgaagagagatccatttggtgggatataattaaaaaaaatgaatcaaaagaaaatctctaaatgcagattccagaaaaattacagcacatctcagtgaatttgcaagtggatcatccttccttgtgggttagcaggcagttataagattgcaaaatgggtctccggattcactttgttgttgacccacatggttggtgctgcatgggtttgattgtctttgtttggttatacaatattgttttaattcccaaaattgtcctctttcctcactatgaagaaggacatattccaggcatattaataataatattctatggcatttccatattctgtctggttgccttagtgagggcctccataactgatccaggaagactccctgagaaccccaagatcccacatggagaacgggagttctgggaattatgtaacaagtgtactttgatgagaccaaagcgttcccatcactgtagccgctgcggccactgtgtgaggagaatggatcatcactgtccatggattaacaattgtgttggtgaagataatcattggctctttctgcagttgtgtttctacactgaacttcttacttgctacgcactgatgttttctttctgccactattactattttcttccactaaaaaagcgtaatttggtaagaaatgtttatattgggaggccgaggcgggcggatcacgaggtcaggagatcgagaccatcctggctaacacggtgaaaccccgtctctactaaaaatacaaaaaattagccgggcgaggtggcgggtgcctgtagtcccagctactcgggaggctgaggcaggagaatggcgtgaaccccagggggcggagcctgcagtgagccgagattgcgccactgcactccaacctgggcgacagcgagactccgtctca

SEQ ID NO: 327226 - DNA, 1235 bp, Homo sapiens
agcggctcccatcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggtggtcgggagagcggcggcagcgagaggcgagccagcggcgacgaatgaagaactttttcacttactgcaggattttcagcttcagcaagcaggttctcatggagaactgttattgaagagagatccatttggtgggatataattaaaaaaaatgaatcaaaagaaaatctctaaatgcagattccagaaaaattacagcacatctcagtgaatttgcaagtggatcatccttccttgtgggttagcaggcagttataagattgcaaaatgggtctccggattcactttgttgttgacccacatggttggtgctgcatgggtttgattgtctttgtttggttatacaatattgttttaattcccaaaattgtcctctttcctcactatgaagaaggacatattccaggcatattaataataatattctatggcatttccatattctgtctggttgccttagtgagggcctccataactgatccaggaagactccctgagaaccccaagatcccacatggagaacgggagttctgggaattatgtaacaagtgtactttgatgagaccaaagcgttcccatcactgtagccgctgcggccactgtgtgaggagaatggatcatcactgtccatggattaacaattgtgttggtgaagataatcattggctctttctgcagttgtgtttctacactgaacttcttacttgctacgcactgatgttttctttctgccactattactattttcttccactaaaaaagcgtaatttggacctctttgtttttagacatgaattggccataatgagactagcagcctttatgggcattactatgttagttggaataactggactcttttacactcaactaattggcatcatcacaccatgtgacatgcctgctcctactctgccttccatcatgaataaaagcttcttgaggcctcaccagaagccaagcagatgctggtgccatgcttatacagcctgcagagccatgagccaaataaaccttcttcttt

SEQ ID NO: 327227 - DNA, 1271 bp, Homo sapiens
gaaaaaactggcaccttttctggaaatctcttattgcaaagaaaagatactgagtgtatagaaaattttgtcaccagaggaaaaataaacaatatataagggtggctttcactttaacatttgggatattttggagttcttgatacctcgaaggtctccatttctattggtattttgaatatctgtaacatgtaatgtcgttcttataacagttcaacactgatttttttggtatcgatagctttatatataaacaaagatgcggacaaaatagcttaacagaagttgtgggcttttttgtggctttgcctgcctgtttgaccaaatacagggtttaattgtttgcaggctgttaactaaagggaaagcttacctgcgtattgcaagctatatattcttgccagtatacattggatgatattttaacctactggtgcctgaagttcgtgttttataacctcaacaactataaaacatcctggtgctattcactttagcattgagtgacatttttaattcctgtaccaaagagttaattttctttttggttgactgagttttcttctcacatcgttgtgtatttataaagtagaatttaatgttactaagaacagtttgattaacagatcttattttttgcatgctgctctggcaatttaatggattttaaatgtttctcatttggatttttttttaggtaggcatgtatggattttaattttgtattttcaatatagcttggctactttaaaaggtagtttgataggctgaaattacaaaagataattgaagcacttttcacaagttgttttatttctgcaacaatgaataaaaagagacccatgattttatgtttctgcaaagctctcatgtctgccttcatagaagaaagttggatctcatactgcttcgcattagaccaattgaattgttattttgttagaagtatctggagaagtctgatcttgtgcagataatgtagttggaaaaaggaggagtattctgatcttttcagatgctgttccactgccagggactccctccccatatcttcctggaaaacacttgttcacccctttggacaattcagttatcacttcctggagggacactttccctgactttcccagaagatttccttctccatgttctgcagggacaccacttatcctgcttccactatagcatgaatcagtgctctctatacaagtgcctagtacactgcttggacctctgaaggtatttagtaaaagtttacttagtaaataagc

SEQ ID NO: 327228 - DNA, 559 bp, Homo sapiens
agcggctcccatcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggtggtcgggagagcggcggcagcgagaggcgagccagcggcgacgaatgaagaactttttcacttactgcaggattttcagcttcagcaagcagatgctgttccactgccagggactccctccccatatcttcctggaaaacacttgttcacccctttggacaattcagttatcacttcctggagggacactttccctgactttcccagaagatttccttctccatgttctgcagggacaccacttatcctgcttccactatagcatgaatcagtgctctctatacaagtgcctagtacactgcttggacctctgaaggtatttagtaaaagtttacttagtaaataagc

SEQ ID NO: 327229 - DNA, 1717 bp, Homo sapiens
agcggctcccatcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggtggtcgggagagcggcggcagcgagaggcgagccagcggcgacgaatgaagaactttttcacttactgcaggattttcagcttcagcaagcaggttctcatggagaactgttattgaagagagatccatttggtgggatataattaaaaaaaatgaatcaaaagaaaatctctaaatgcagattccagaaaaattacagcacatctcagtgaatttgcaagtggatcatccttccttgtgggttagcaggcagttataagattgcaaaatgggtctccggattcactttgttgttgacccacatggttggtgctgcatgggtttgattgtctttgtttggttatacaatattgttttaattcccaaaattgtcctctttcctcactatgaagaaggacatattccaggcatattaataataatattctatggcatttccatattctgtctggttgccttagtgagggcctccataactgatccaggaagactccctgagaaccccaagatcccacatggagaacgggagttctgggaattatgtaacaagtgtactttgatgagaccaaagcgttcccatcactgtagccgctgcggccactgtgtgaggagaatggatcatcactgtccatggattaacaattgtgttggtgaagataatcattggctctttctgcagttgtgtttctacactgaacttcttacttgctacgcactgatgttttctttctgccactattactattttcttccactaaaaaagcgtaatttggacctctttgtttttagacatgaattggccataatgagactagcagcctttatgggcattactatgttagttggaataactggactcttttacactcaactaattggcatcatcacagatacaacatctattgaaaagatgtcaaactgttgtgaagatatgtaggcatgtatggattttaattttgtattttcaatatagcttggctactttaaaaggtagtttgataggctgaaattacaaaagataattgaagcacttttcacaagttgttttatttctgcaacaatgaataaaaagagacccatgattttatgtttctgcaaagctctcatgtctgccttcatagaagaaagttggatctcatactgcttcgcattagaccaattgaattgttattttgttagaagtatctggagaagtctgatcttgtgcagataatgtagttggaaaaaggaggagtattctgatcttttcagatgctgttccactgccagggactccctccccatatcttcctggaaaacacttgttcacccctttggacaattcagttatcacttcctggagggacactttccctgactttcccagaagatttccttctccatgttctgcagggacaccacttatcctgcttccactatagcatgaatcagtgctctctatacaagtgcctagtacactgcttggacctctgaaggtatttagtaaaagtttacttagtaaataagc

SEQ ID NO: 327230 - DNA, 878 bp, Homo sapiens
atcctgggctctggacaatgccaggcacatggtgggttgtcaataaacagtggttaaaagaaatactgagcaagacagtaagtgacacaaatgttatttggagatgcttaacacgagtttattcttgacaataagcaatacatcttgtaggcatataaaatgtgaagagcaatatgtacattaacatggaaatgtgaaaaaacaaggtacttttctcaatgaactcaaggaatagcaagaaattctatatcttcagaaaacaggatgatgagaataaatgaaaatggagctagattccaacagctttctaagataagttaacttaacttagaaagataaaagttaacatatcttatatctttgggcaatggataattattaaggaaggcatttgtgcaagtgaatggcatgatcagttttttgtgctttaggaatacaactctggagagtgaactgcagaagaggagaaaggcaagtttaagtagaagttaaaaaaattttctgagcagaaaacttaataacggcttagagatggaaaaaagatagagggcagaatcaaggatgaagtctagatttccggattgggtaaattgatgtatgattctattcactaacagggaatcctagagcaagtacagatttgggggaaattttctaccagctgtagtaagcttatgcaccaaaagtaaataacaactaaccttacaatgttataagttaattggctatttgttcctacatcaaaaacacttatattagtcaggcatggctactccagaggctgatagtaggcggatccctacagcctgggagttcaaggatgcagtgagctatgatcatgccactggactccagtttgggtgacagagcaagaccct

SEQ ID NO: 327231 - DNA, 679 bp, Homo sapiens
agaacccccgatattaggcggggaaacatgattatgtgtcatgtgttttcagatagataggaaaaggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327232 - DNA, 491 bp, Homo sapiens
aaggtcactcccaaggatttcgctgggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgacgagtccagcggatcctctagagtcagcctcc

SEQ ID NO: 327233 - DNA, 762 bp, Homo sapiens
gaggaatggtcacatttatgagttaactggaagaaagagacagagaaggagtgtcaagagaggtgaaagccaagagcaggtgccaaagaaagcgagtacacttctaaggaaggaggaaatggtcagtgagtcaaaatattcccaagaggggtccagctagcgaggaggaaagctgtgatggggtgcaggagtggaggagaaacgtggcaactgccgaataaacacaccaaccagggaagacggccaaggctgggcccagaatatctggaatggaacccatcttccttttgcagcaggaagtggagttggaagctgagttgactgtggaatttccgagcttggaggatgttattactacaagaccttaacggttgttggaggcacaagatggaatgagcctagatccctgaatcactatgtggaggaaggccattatgaaacaggaatattcctttattgtgtccgtaagatctaaacttctattacgttggagtcatttattcttgggtctctgttccactagccagcattactgtaactaacatatttcttaaagcccttctttgttactcacctttcatcatacatggtaacccagcgccttgtgatggtgggtgtgaagtgctccgcacatgtgaaatctgactgtgatcaatgctttactaatgttccaacacaaaatggaatctaagtcagctgcactaatgtgacagagactggtgctaataattactgacatttggagaggacctgatggcttgg

SEQ ID NO: 327234 - DNA, 380 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggtacggtgcgcccgctctccggccccgggccccggctctcagcctcccccgggcgcaggcaggggctgcggccgc

SEQ ID NO: 327235 - DNA, 2345 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctcaaaatct

SEQ ID NO: 327236 - DNA, 2404 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcatggaagctccacaaagcagcagcctggtcaccttttctcttccaagtgcccagaacagcccctggatgctaacaggggcgccgtaaagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327237 - DNA, 2092 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgacgagtccagcggatcctctagagtcagcctcc

SEQ ID NO: 327238 - DNA, 1940 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcaccgtgggtggtggaatagtacttgcggtgggtggcctcaccggaaaacagcacttgcatgggcgctgtctttgagct

SEQ ID NO: 327239 - DNA, 1588 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327240 - DNA, 720 bp, Homo sapiens
agaacccccgatattaggcggggaaacatgattatgtgtcatgtgttttcagatagataggaaaagtaaggtggagcgttttgccgggggtcacaggaggcgctgaggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327241 - DNA, 2205 bp, Homo sapiens
ctttctgtgctgatcttggaggcagagtggctgcctgcattcattccacggtccattccacagcttgttccaaagacagtctgctcatgatgtagcttctgcacttgacaaactattttcatgcacgaggcccttgaaaatgttgacagtcttgtgacatccatggagggccttatttgacggtcacaaaggagcggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327242 - DNA, 2314 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327243 - DNA, 2155 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327244 - DNA, 2359 bp, Homo sapiens
gaggaatggtcacatttatgagttaactggaagaaagagacagagaaggagtgtcaagagaggtgaaagccaagagcaggtgccaaagaaagcgagtacacttctaaggaaggaggaaatggtcagtgagtcaaaatattcccaagaggggtccagctagcgaggaggaaagctgtgatggggtgcaggagtggaggagaaacgtggcaactgccgaataaacacaccaaccagggaagacggccaaggctgggcccagaatatctggaatggaacccatcttccttttgcagcaggaagtggagttggaagctgagttgactgtggaatttccgagcttggaggatgttgttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327245 - DNA, 2242 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327246 - DNA, 1759 bp, Homo sapiens
agggatccagcagtctccggcttcaggggcttctagcttcccggctcccggcggggcgggcccggggaggagctcggcgggtccccgcccagaggcggagcggagggccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagaggtgcgccacgtgccccacgacccgcttcccccaccctgcttcttcctcacctgccct

SEQ ID NO: 327247 - DNA, 713 bp, Homo sapiens
aaggtcactcccaaggatttcgctgggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcc

SEQ ID NO: 327248 - DNA, 872 bp, Homo sapiens
gctgggagctaccagagtatttgaccttgggcacagctggggtggccccgatggcgctgctgtctgctgatggtctccacagcttccccagcgaggccttcctggaaggagtgctgagcagcaaagctctgtggtcacgactcaggacaaaggggaaccagctgaacagagcctttcatgtgacaacaaaaaacgacctggctcaaacatcacgacaggcatctgtggagcctgggaaatgacctttctcatggggagaacacagaacacacaaagctttctcttaaaagtctacaaaattataatctgataacaacagaacgttttggtattttgagtaataggtgtcacatcggaattgatatttgccaaatttggcatgataattgaatgctttttgcttatttatatttcatattttagttgttttctaataaccaaaaacatttgtgtatttttaataatagtagaggtaaatgaaattttacatgtcagtaaaaaaactgaaagatgatgcttgtaatttcaagtcgattaaagaaaattattaataaaacaataaaatacaaattatacattttatattgtgatacttaaagtagatgacctggtttatccctgaagagaaagcatggatgcataaaccagaccatattgtaaatatttcaaattcattggtaaacattgttttaagaaggtgattagcaaatattgtttcaagaaggtgattaagaaggtgatgcaaaatttggagtactttctgttttgtatttttcgtgactatttgtgagcacttggtgcttaagacacactcaaagaggtactgacaatttatcatattctaaagcaataaaacaggttgaaaatatcta

SEQ ID NO: 327249 - DNA, 278 bp, Homo sapiens
taaatatttattgagttattttaacagccacccaatgatgatgaatactgttatctccattttaaagacaagagaaactgaggtataaatagattatgtatcttacgttcagtcatgtcactaccactaaatggcagattcaggatctgtctgacttccaagttcttaacaacaatatattttttttctcttttcactccatctaggcctctgtttttgcagttctgcagcacatcaacgcttgattccaaattcagattgttaatcatgttcttgtc

SEQ ID NO: 327250 - DNA, 1060 bp, Homo sapiens
  misc_feature (864)..(864): n is a, c, g, or t
ccaccccacaccaccaccacacaccacatagcaggtgagacgcggttaatcggccgagggtaccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaangttttgtgtgggagacctccacgagggggttgggaaaaaataatcgggttaattattaaccagtgggtcccgggtgggtaggctaaaaacgataagtgggaaagtaggttggagtgcgcaggattgggggaggatgagggtccaatgtgaacgcgggtgggaaagattattggcgggataactggagagacacatg

SEQ ID NO: 327251 - DNA, 807 bp, Homo sapiens
gtgcagggacagggacagcacctacttttctggcacatgggggagtccgccctggagggaggcagctctttctgcatgagtcgccatcctgggtgctcatctttcagggaccctaggagccctggccatcaccccagctgatggggtctgccagctgggttcggaagcctgcactctgagatgctgggtgccctgtcaccaggtgtgcttctgccccgttcccagcctgcccctcccctgaatgcctgtcctaggctgtgtgcactggtcgggctgggcagccctgggacccagctgggcacctgttctcccattaacacagggtgccctggtcctggtccccgttcctgccttgaggcctgccaccctcctgccctgccctccaagggtatggggggcctgggcagtgctcaacctctgcccagccttgaccagagaccttgctaattgacaatggacaatgctggtgcccagcccagactctggggtggggcagtgcttgagggggtccttgactgtgggacctgaggggctctctggcagctcctcacgtgtgcacatcaccttatagtcacccttcatcctgggtcattgagagtcctgtctgcagccagatgccagcaggctgtggtcctgtagtccctgagccatggaggcagggtgggctcatcctgtgcaccttgttccacagtctccctctttcccaatttacaagaagaccaataagaaaaataagaaaacaagaaagaaaaaggaaaaataaagttatcacctcctggtagcagggagggtctctcagagctgggc

SEQ ID NO: 327252 - DNA, 501 bp, Homo sapiens
catctgccacccgtgcaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagaggtgcggctgctccccgcatattcacgcgcacgcatgctccccacatatccacactcacgcatgcacgtggcacgctcgccagatttcccacacactcaccctcacgagcctgctgcagtcctggtacaaggagggccttgctgcaccaacctcagcgcctggtgctcagaggctctgg

SEQ ID NO: 327253 - DNA, 529 bp, Homo sapiens
  misc_feature (523)..(524): n is a, c, g, or t
ggcacgaggggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgaggctgtggccaggccagctgggctcggggagcgccagcctgagaggagcgcgtgagcgtcgcgggagcctcgggcaccatgagcgacgtggctattgtgaaggagggttggctgcacaaacgaggggatggtttatgttgaatgtttagtttttcttctgcatgatacgtcatgttgtgggatctttagaaaacttcatactgtatgaataagaaaataaaatatttgaaacttgcaaaaaaaaaaaaaaaaaaaaaaaaaaaaaaaaaaaaaaaaaaacacaaaaaaaaaaaaaaaaaaaaaaagggggggggggnntaaaa

SEQ ID NO: 327254 - DNA, 221 bp, Homo sapiens
tcagtgtcgtcagagccccctgtgcctgaggcgtgcgcggctcggagccctgccctcggagtcctgcggtgccttcctcgagtctggcctgctttccatcctgctaagtacttggggcatttccctctttgggtaaggtgtggtcttccctgtcctggcattagacacaaggcagtgggccttcctgccattctaagtgtagcttaagacaatcagtgcaa

SEQ ID NO: 327255 - DNA, 2897 bp, Homo sapiens
ggcacgaggggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327256 - DNA, 2617 bp, Homo sapiens
gtggagcccccaggcacgtgcagtgggtctctggctcacccagggcgaggagctgcccttagccaggcgtggcctcacattcagcttcctttgcttctcccagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327257 - DNA, 2409 bp, Homo sapiens
gctgctctagaggatcctcagggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327258 - DNA, 2350 bp, Homo sapiens
tagctagtacgggccgggggttaatcggccgagggcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327259 - DNA, 3227 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaaaaatttttggctcactttgctgggtggaagagtgggtggccagggagggagtggggagtcctgggagggaagcagcatcctcagagcagctggtcctccccagctcctcctggtgggcaccgccaccccaacaggtttggggacaggctgtgtggtgggccgaggcgggagtatacaggcctgttcccaggggcagcctcccatggaaggtgttccacccccatctccagaggcctggcctgaggggagatgggaggccctggctggcctgcccccgttgggatccacctcttcttccct

SEQ ID NO: 327260 - DNA, 2904 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327261 - DNA, 3002 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaaggtgcgctggcgggcaggcaggggggcagggccctgggggcctggcggcactgacctgaggccacctttcccctagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327262 - DNA, 3022 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagggaccctaggagccctggccatcaccccagctgatggggtctgccagctgggttcggaagcctgcactctgagatgctgggtgccctgtcaccagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327263 - DNA, 1875 bp, Homo sapiens
agactttccaggcccccgtgccctctggtggctggtcccttccctgtgcaatgccgagacccggtctgagaaaccccagccctgcaggccatgggggcagaggcccgagccacggctgtgcctcaggttgcgcctcccgcagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327264 - DNA, 2518 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgcctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327265 - DNA, 1695 bp, Homo sapiens
agtagccattccggaatggcgcacggtagccattccctcttctcccctgtacgtgaccgtcaacccctgaaactcgccatcaccacttcatgctcgccacctccaggccgaggatccagagtcgatccggacgtctcgccagctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327266 - DNA, 1956 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagagtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327267 - DNA, 1977 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagtcgccccggctacggatggggtggtggaggctgtggtgctggtagtggttgtggcggcggcggcatgtggctgctgtggagccggtggtgccgcatgctgcatgactggttactgcgaggcctctacaccacgcagctctgaggtgaccattgatgcgtgcagttggcagcaggctgacgcatgctctgcatgatcatgctgcagctcgcgccaagttggtccgg

SEQ ID NO: 327268 - DNA, 1829 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagtatcgtagatagaagcatcagcacaccgcgttctagcctgctaggacaccgccagagttttccccaagataatccta

SEQ ID NO: 327269 - DNA, 923 bp, Homo sapiens
ggaggaaggcacacgcgagaggcatactatgacactcctagaaggcgccgaggtcactgccgtgtggggcgccacgagagggctcctgccgggagagtggtggggacgaaaacatatccgtgaggtggttatcaagatgcaatctactcgagctttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327270 - DNA, 1484 bp, Homo sapiens
  misc_feature (1380)..(1380): n is a, c, g, or t
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggtccggncgggccatgaaaactttggggccactgagtctggcccgcggtttgggacacgctcaagcggcggacgggggcgggggggtaaaaaaattgggcccttcaacaaa

SEQ ID NO: 327271 - DNA, 1383 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgaccacacgaccacgaagaattccggccgtggtcgt

SEQ ID NO: 327272 - DNA, 1212 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaacgacatccaaggtcacagtcgtgagagtgacagcatggtatttagatgaggagttcatcggccacgatggatactaccattcgagcaaccaacgctggaactcaacaaatggacagccattggacgtgtgtggggacaagagaggcgccaggccacctactatccactcctagttctgcgctactcaggcgcacggcgagcgacaggtccttgaagtggccggactgtgttgagacccttgtctgggctgtgaaccggataacgcgtttggtgaaagagggaaattgtggaggaataggggtacgccgccaattacgggtggcaccaattggaggttgatgtataactattacagttggggaaatcatggtaaataagtcaaatacaggaagtttgccaattgttggagggaagtaaa

SEQ ID NO: 327273 - DNA, 2719 bp, Homo sapiens
ggcacgaggggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327274 - DNA, 792 bp, Homo sapiens
aagtattatcaggtgccgagatctcgggtgtaaatgcatgcagaggcgcgatgtgaaaaggatgactggtcgtcgctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccggtccggtttaaggggcaattcccggggcgttggaaacccgtgcctctcggccgatggaaacgtttgtctgtgggcctccccggcgggggaaacctgg

SEQ ID NO: 327275 - DNA, 2927 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327276 - DNA, 2621 bp, Homo sapiens
tcagtgtcgtcagagccccctgtgcctgaggcgtgcgcggctcggagccctgccctcggagtcctgcggtgccttcctcgagtctggcctgctttccatcctgctaaaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327277 - DNA, 2797 bp, Homo sapiens
cagcccctgtggccatagctggggcccgagctgctgctggtgcctgctggggactggctggtttagggctgcctcctccaggaaggctgtgcagactggcccagacctcttcccagcctcctgtccatggtactccatcccctgcgtccagctggcccagcccgttttcagacacagctcggggtggctcttctgagaggggcgctgtggtggggcgagtctgccttcccgttgacccagggccgtttctgtcgctggccctaagaaacagctcccgtaccgcgcctgccccctgggactcaggcatcccaggcacatctgtcctggcacacccagttcctgcctggctgcctggcgagggtctgacgggtagagtgtgcgtggctctcaccacccgcacgtctgtaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327278 - DNA, 2981 bp, Homo sapiens
  misc_feature (2975)..(2976): n is a, c, g, or t
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaaaaaaaaaaaacacaaaaaaaaaaaaaaaaaaaaaaagggggggggggnntaaaa

SEQ ID NO: 327279 - DNA, 2239 bp, Homo sapiens
ggacgcgtgggtcgcggacgcgtgggatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327280 - DNA, 2872 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaatatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327281 - DNA, 1876 bp, Homo sapiens
ttcatgtgtcccccgggtttggatatcgtcgaccgcgccgttcgatcgagaaccggctcctgcagatctccagggccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327282 - DNA, 2877 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327283 - DNA, 1729 bp, Homo sapiens
aacaaatgatgtatgaggcgatcccggtgttatttcgtcacaggcttcgtagtgcgctgataattgtcgtggccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327284 - DNA, 2262 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgaaaaggggcaccagggggggtgtttgtggacaaataaatttgtaaagtccgaggatta

SEQ ID NO: 327285 - DNA, 2268 bp, Homo sapiens
  misc_feature (2072)..(2072): n is a, c, g, or t
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaangttttgtgtgggagacctccacgagggggttgggaaaaaataatcgggttaattattaaccagtgggtcccgggtgggtaggctaaaaacgataagtgggaaagtaggttggagtgcgcaggattgggggaggatgagggtccaatgtgaacgcgggtgggaaagattattggcgggataactggagagacacatg

SEQ ID NO: 327286 - DNA, 2133 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327287 - DNA, 2452 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagggaccctaggagccctggccatcaccccagctgatggggtctgccagctgggttcggaagcctgcactctgagatgctgggtgccctgtcaccaggtgtgcttctgccccgttcccagcctgcccctcccctgaatgcctgtcctaggctgtgtgcactggtcgggctgggcagccctgggacccagctgggcacctgttctcccattaacacagggtgccctggtcctggtccccgttcctgccttgaggcctgccaccctcctgccctgccctccaagggtatggggggcctgggcagtgctcaacctctgcccagccttgaccagagaccttgctaattgacaatggacaatgctggtgcccagcccagactctggggtggggcagtgcttgagggggtccttgactgtgggacctgaggggctctctggcagctcctcacgtgtgcacatcaccttatagtcacccttcatcctgggtcattgagagtcctgtctgcagccagatgccagcaggctgtggtcctgtagtccctgagccatggaggcagggtgggctcatcctgtgcaccttgttccacagtctccctctttcccaatttacaagaagaccaataagaaaaataagaaaacaagaaagaaaaaggaaaaataaagttatcacctcctggtagcagggagggtctctcagagctgggc

SEQ ID NO: 327288 - DNA, 969 bp, Homo sapiens
  misc_feature (24)..(24): n is a, c, g, or t
cccaagctacggctaggtacgagnctgggtggcgcatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327289 - DNA, 1618 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtggcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 327290 - DNA, 1498 bp, Homo sapiens
ctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagcggagaacccatgctggacaggcggcctttaatccgactcggctggcggggggtaggacaggcccgaaattgggacgaatcggccggtgcgaaacaggcacacggggcgggtacaaaatggccccaagcaaaaagacagagaacccaacgatttgaaaccggaccactggcaccccac

SEQ ID NO: 327291 - DNA, 682 bp, Homo sapiens
ggcagtgctctgagggcccaggtccctgtgtcaatctgtggggccctgtctcagtttcctggcagtatggcagcgtgctggccgtgctttaagaggttggcttcctactggagctgtgggtgggtggaggtggcagggaggtggggcaccggggtctgagctgtctacacccacagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaa

SEQ ID NO: 327292 - DNA, 1907 bp, Homo sapiens
  misc_feature (1)..(3): n is a, c, g, or t
  misc_feature (21)..(21): n is a, c, g, or t
nnnggatagatacggtgttantagatgttggctgaagctggggtaaaacagtcctcagtcctctgggcctttctgaggtcagggcttagcaccatgtgcgcttcctaatgagccaggcttactgggtttaaattgtttccttgatcaccataaaaagaattataaattttatagaatgggtgcttttattcaaacatgtttagagatgtggatattttggaaataattagaaatcaaaacatgccataaaacttctgttggctgaagagctatacataaaggataataggtgggtattttgcaagcaactgaactgggatcataaaataacaagtataactcttgcatggctagtaagttattatcactcagtttcaaacgcctagtcaagacattgagacagactagtggggaaagctgcatgatctctacactgtgcctctttagccgggcagcttgccctccagcttgagagtgagccccggtgttgactttgctgatttgtgcagtggcaggcctgcatgcaggtagcacttgcagtacttgggtctagctgctcttccactcccagcacctctgagatattttcagcaccagctgtgtgtcatttctagttactgagctttgtgtttctggagaggattttccacagatactgatgctgatttctctttctacccctctttctctcctcctttgcctctcccttcagtcggcagcacctcttcctcaccagcactgttaggaatcagagaccctcgctctgaatacgataggacccagccacctatgcagtattacaatagccaaggggatgccacacataaaggcctgtaccctggtaagacgccagttgggtgtgtgatacagtctcttgaaaagccgcatttccaggcgcttggccagtggcctgggaagtagcctgtgcttgtattgagacagtcccccagcagcaaaccatgttccagtcattccctttcctactttggggattgttgccttttctgcttgtttaaagtaaaacaagcatgtacttgtttgtatgtatgtatgtatgtagttgtacggtgggcacaaataaaaagagggctgtatccaaataaatcatttctggctgctcactggcacagtccctttgctccgtcccctcctggctcgagcagtctctgtgttttccacatgcatcagaaccgtcagcccagtgtcactttgcaggggccacatcttctagactggctcatctcttaaattcaaaccagagaatggagatcaatttcatttacattttcatggagaagagtttgaataaatagcaaaaggtataatgtgattcttctcaacgtgattattttttaagaataacaaaaataatgttacatagtgttaatatttttatatcctattcagaaagctgtgcatacaatttatttaaaggataccagcccaaagggttactaagatttcatactgttcccattctcaaccgtctggcgattataactactttagatgttccaaataagtcagtgtgagctaccccacaaaaagtactcttttctcaaacctgtctattaaaaataaataaaagctggtggcagctttactcctgctgggggggcagtctccattgtactgttgtctttgaaattgtgatttcacaggactatttactaatcgactgttgttactatggcaattaatagctcagaaaattgcagatgctacatttcaacaccaagctctgggcaaaaggaaatgcacataccaactgaagtgcatggttgcttccgatttgcagcagcctgctttatcttacagatcacctctttagcatgcatgcccttctgtatcttcttcgcttgcttcaataaactaatttgcctcaactacgtttcattttcctcatt

SEQ ID NO: 327293 - DNA, 5054 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327294 - DNA, 4925 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327295 - DNA, 5005 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327296 - DNA, 4851 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327297 - DNA, 3451 bp, Homo sapiens
aaacatacatacacagatacacacacgctcacacacacagggagacatacacacagacacagaaacacacacgctcacacagggagacatacagacacagaaacacacacgctcacacacacagggagacatacagacacagaaacacacacgctcacacacacagggagacatacagacacagaaacacacacgctcacacacacagggagacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327298 - DNA, 2942 bp, Homo sapiens
ttctgactggaggctgcgatgcttgtgacggtgcgtacgtttaacaagcgttcgtgacatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327299 - DNA, 4643 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggtaagacgccagttgggtgtgtgatacagtctcttgaaaagccgcatttccaggcgcttggccagtggcctgggaagtagcctgtgcttgtattgagacagtcccccagcagcaaaccatgttccagtcattccctttcctactttggggattgttgccttttctgcttgtttaaagtaaaacaagcatgtacttgtttgtatgtatgtatgtatgtagttgtacggtgggcacaaataaaaagagggctgtatccaaataaatcatttctggctgctcactggcacagtccctttgctccgtcccctcctggctcgagcagtctctgtgttttccacatgcatcagaaccgtcagcccagtgtcactttgcaggggccacatcttctagactggctcatctcttaaattcaaaccagagaatggagatcaatttcatttacattttcatggagaagagtttgaataaatagcaaaaggtataatgtgattcttctcaacgtgattattttttaagaataacaaaaataatgttacatagtgttaatatttttatatcctattcagaaagctgtgcatacaatttatttaaaggataccagcccaaagggttactaagatttcatactgttcccattctcaaccgtctggcgattataactactttagatgttccaaataagtcagtgtgagctaccccacaaaaagtactcttttctcaaacctgtctattaaaaataaataaaagctggtggcagctttactcctgctgggggggcagtctccattgtactgttgtctttgaaattgtgatttcacaggactatttactaatcgactgttgttactatggcaattaatagctcagaaaattgcagatgctacatttcaacaccaagctctgggcaaaaggaaatgcacataccaactgaagtgcatggttgcttccgatttgcagcagcctgctttatcttacagatcacctctttagcatgcatgcccttctgtatcttcttcgcttgcttcaataaactaatttgcctcaactacgtttcattttcctcatt

SEQ ID NO: 327300 - DNA, 3781 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctgctcagaaaattgcagatgctacatttcaacaccaagctctgggcaaaaggaaatgcacataccaactgaagtgcatggttgcttccgatttgcagcagcctgctttatcttacagatcacctctttagcatgcatgcccttctgtatcttcttcgcttgcttcaataaactaatttgcctcaactacgtttcattttcctcatt

SEQ ID NO: 327301 - DNA, 2799 bp, Homo sapiens
ggaggcagacatgggacttggggatatagttgtccccagggagggagttggggcatctgttgtcacgccaaggatctgcagtagtgagaagtgaggctcaagcatcatgggtgcagtctgcacggcagcagccctgaagagaaacactgggccggagcctcaagcatttcggtcggcatgaagtcaaatcctcagcaggactgagaagggctctgcatcctgtcatctgggtattccacaaacactctagaatcataattctctcttcagattgtttcaagttctcataaataaaaagtagttctttcatatttcccatttatttcctgtctgtagtgttcagtacagaagtgttttgctctaatgtgccgagttgtttttaattatacgccatgctgggtttcagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327302 - DNA, 3486 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327303 - DNA, 1455 bp, Homo sapiens
tgtggtgatctagaggatccctcaaaacgtatagaacacaatagacggctaccatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327304 - DNA, 1192 bp, Homo sapiens
tgcagtcactctaaggatcccgccatcgcacctggcttagttcccttttctctgcatcttgccagcgttgtatatgtctttttgataataattatcctaaacggggagagtgatacctcattgcggttttgatttgcatttcccagatagtgatgagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327305 - DNA, 2833 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccaggcgagtaccagttaggagtctctagaaggctacagtattgcaggagtcagccagttcctccattttgacttttttaagttgctaagtctattatactatcattatactatcattaattccatatatattaatacttccagttgtattccagctatataggtcattgaggttaatttcattttaaagatagattccttctttccatcctttcataataagttagagaaggcacagatccatgggaatatctgcagcattcatcactgaaatatttcatcaagacaacaacctggaatagcctcttggaattaaacaaggctttgaaagatcaatttaccctttgcccttatcctgaccgacttcttcgataacagcttcaaaaaatggatttggttattacaaactagagaaagacccgtgttacatgttttcaatcatagtggtcaacaatatataacgctgttattaaccaggtcctttgaaaacaatttgtgacatttaggagaagacagtctttataagaaattctatctaataagcaaaaagtgtttggcaaatcatagacgtttcctccttctgattttatttggccctgtagacagcattttttattaagataatatgagtcatttaatacttgattgattttgaaaaactgaccttgtccttaaagccatttaaaatattcaggaaataaagatattttgaaactaaaagaattttcatttctgaaagagtgaaattgttgctaaattttaagcgctttagtgttattttaaggcatgtatgcaagatttcattcactcttcgcccacaaatagttgcttcactggaaaattgttataattatcaattcatttttagcagcctaccaacttgttttaatgaatgtgaattaaaatgatgagtgaggttttggtcattaaaacaaaatgactaaagatacctta

SEQ ID NO: 327306 - DNA, 1015 bp, Homo sapiens
tatacaactacataatgtgagcccacacagaaagcccctggaatccacagacccacagattgcgcaaatagttctttgaaagtgaccaggaagcaggaaaaaggtcctatgtcccctgggggatggggagcgtgacttctgctggaagctgccagccatgttccaaagtcatgggccaaaacattcaactagagaccccccacaaccctctatcatctttacctccgtctccataatgtgtgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327307 - DNA, 351 bp, Homo sapiens
tcactagttctgcgtaacacgacaggttgcctaaggtaaattctttatttcttctttccagttaattctgtgattaaatatgtgtcataggtaaattgattttaggaggacttactttattaacatctatctaagtttccagtttttatttcaaaatttaggccactggactttgttattctgggagaaaaacatcgtgagcacagacttgtggccttaaagaagttatcttgtaaatgactcttctgtgacttactcagaaaggccctttcagtctaagattactgccaaaattccagtgttttccactttaacagcatttttctggtaatcgcattctgattgctaatg

SEQ ID NO: 327308 - DNA, 5050 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgacaggtgcttgcacgcccttctcccttccactcccttgcctttcctccttccctgtcctttcactccgccccccctgtcctttacctctccccccctgtacccacctccccgctctcatctcttcttcttcgctcctcgccccctctcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327309 - DNA, 4532 bp, Homo sapiens
tggccggacagaccgggaccgtgcgagacacagcaccactattctagcatcgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327310 - DNA, 3201 bp, Homo sapiens
ctctatttttagtagagacggggtttcatcatgttggccaggctggtcttgaactcctgacctcaagtgatccgcccatcttggcctcccaatgtgctgagattacaggcatgagccaccgcacctggcctctccttagaatgtataaaagttgtcttatttggaataaaaagtaacctttgaaatggtctagagatatccacatcctgtgatctctccataacggacttctgtttgatcactgattaattgcatgttacttaggcctggtacctaatatttttcattctaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327311 - DNA, 5032 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaaggaggccactctccagatcaaagggcaagtctccaaagttacaggggcaaggacgtggcaacttaagaaaatatcctgagaaccgtgagaacagagtggcttggtgtgacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327312 - DNA, 2587 bp, Homo sapiens
caccaggctgtatgaattatgatgctggatgtttctggagatttccctttcttctgaggcaagggatttttccaactaatctctttgacaggtttctgaactcgaaatattgttgcagggaatatagaaaaaaaatgacttgatggagacaggttctcctttcatgtgtgctgatgggttactgtctctgccatcctatttatagcctctgggtttggcaggggaccaactgcaaagaaaacacacgatccttccttaatcatgtttatgtatctgagatagaaagtaatcactgccttctcttttctgcacaaaaatatctggcagatggtggtttgagattttcaggctttgggatttttttttaaatcagtcattccagcctatctttctccccaactttggttttctcttcactgacaccacagatttgatcttcaattggaaagaaaccatttaatctattagttcatcttttggaaacatcttttttaggtgacagtaacatatgagagtggaactctgttttatgttacttcctgccttatttttctcactagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327313 - DNA, 2553 bp, Homo sapiens
tccccttgccttgtcttagcaagaatttcattattattgcattattcctgggagataacatacctataattttaataccagaacttttacttgtgtcatcttttaaagaaactaacatgttgccaccgttgtcagatgagttgctgtacacctcagctctatacacaaaaatgtgtaactgtacccagttcatacattaagatccagaaagatctaacgaaaagtattgtttggcagcctgacttggtccagattcaaaggtaagttttaaaaagctctaagaggaaattgaggtatttgtgatgcataggaattccattgagaataaaatttactattataattccttcattactcaatgttactgaaaatacttgaacgaaagtaacttgatttgtctacccaattttacgcattgatttacatttgctttcagcaattgacagtaatgttttataaatgaatcatttctgcaagtgacgttgcaataaatgttagctttccccttataatgacatttgtccttttcttctttgccatgggttttgattttttcccctattattgtctctttgggggttttatttttaagagattgcatgccaccagaatctgaacaacaataacaaaaacctagtaccttctggaagtagaatttactcttttgccgttggcaggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcgttcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaatt

SEQ ID NO: 327314 - DNA, 1258 bp, Homo sapiens
ggccgggcgggagggctggcagcggggcgggcggcggcggcggcctctgggcagtagagggggctccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcaggtaagccaaacgcatcaagatctctgcaaagaaataccttccggccgggcacagtggctcatgcctgtaatcccagcattttgggaggccgaggcgggtggatcacctgaggtcaggagttcaagaccagcctgcctaacatggcgaaaccccgtctctactaaaaatacaaaaattagccgggcgtggtggcgggcgcctgtaatctcagcaactcgggaggctgaggcaggagaatcacttgagcccaggaggcagagcttgcagtgagccgagatcgcaccactgcactccagcctgggcgacagagcgagactccgtctcaaaacaa

SEQ ID NO: 327315 - DNA, 1208 bp, Homo sapiens
gacagggcagactgtgcccatctcctctcctcaccagctgtgtacctgggcgagtcactttacctccttgagcctcagtttcctcatctgtaagatgggtagaaagaaagactctgcagtcagggtgctgtggcgggttagtgagctctatgagtggtatccacgtccgggattcttgtgactgccgttgtgcccttttccagggctgcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327316 - DNA, 3171 bp, Homo sapiens
agcggctgaacggacgccgtagccgagaggttgggcggatgttgtgaaccgggtcgcggcggccgaggctcggggtgagtgaggggcggcagggctctgagcctggcgggttccggctattcccttcgcggtccagtttagtccagtgcgagggcacctgcagcgccgggatctgagtgcgaaactccgagcggaagctggtctggcagcctccaggaccactggctgcccatgagagacgaaggatggcatccaagggggccggcgtgtctttctcccgcaagagctgtaggctgacctcagatgctgagaaatccagggtcacaggcattgtgcaggagaagctgctgaatgactacctgaaccgcatctttcctcttctgaccatgcacccccagcagccaccggcagttactcgggaggctgaggcaggagaatcgcttgaaccggagaggcggacgttgcagtgagccgaggtcaaaccagtgcactccagcctgggcaacagagcgagactccatctgaaaaagaaacaaaaacaaaaaaaaattttggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagtccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327317 - DNA, 3152 bp, Homo sapiens
agcggctgaacggacgccgtagccgagaggttgggcggatgttgtgaaccgggtcgcggcggccgaggctcggggtgagtgaggggcggcagggctctgagcctggcgggttccggctattcccttcgcggtccagtttagtccagtgcgagggcacctgcagcgccgggatctgagtgcgaaactccgagcggaagctggtctggcaggtcctctggagcttggggccaggcgggggcgacttgggggagccatccttgggctcccagacggacctccaggaccactggctgcccatgagagacgaaggatggcatccaagggggccggcgtgtctttctcccgcaagagctgtaggctgacctcagatgctgagaaatccagggtcacagttactcgggaggctgaggcaggagaatcgcttgaaccggagaggcggacgttgcagtgagccgaggtcaaaccagtgcactccagcctgggcaacagagcgagactccatctgaaaaagaaacaaaaacaaaaaaaaattttggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagtccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327318 - DNA, 2952 bp, Homo sapiens
agcggctgaacggacgccgtagccgagaggttgggcggatgttgtgaaccgggtcgcggcggccgaggctcgggcctccaggaccactggctgcccatgagagacgaaggatggcatccaagggggccggcgtgtctttctcccgcaagagctgtaggctgacctcagatgctgagaaatccagggtcacagttactcgggaggctgaggcaggagaatcgcttgaaccggagaggcggacgttgcagtgagccgaggtcaaaccagtgcactccagcctgggcaacagagcgagactccatctgaaaaagaaacaaaaacaaaaaaaaattttggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagtccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327319 - DNA, 2810 bp, Homo sapiens
agcggctgaacggacgccgtagccgagaggttgggcggatgttgtgaaccgggtcgcggcggccgaggctcgggcctccaggaccactggctgcccatgagagacgaaggatggcatccaagggggccggcgtgtctttctcccgcaagagctgtaggctgacctcagatgctgagaaatccagggtcacagggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagtccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327320 - DNA, 2901 bp, Homo sapiens
aggactaggcacagccttttttctggagtctaggcagcccccctgtgagctcaggggaatggatgggatttagtgtcatctggctgatatcaaggacttacttttagttagtaatcttttcttttctttatggctcactgcagccttggcctcctggtctgaagcaatcctcctacctcaggtcctctaatcccagctacgagggaggctgagacaggagaatcgcttgaacccaggatgtggaggttgcagtgagccaagatcacatcactgtattccggcctggacgacacagcgaaactctgtctcaaaagaaaaccacaaaaaaacaacttgtgccccttactcctgccacctgggtaagtcctccagtgctttcccatgagataaagctggtgggaacctcattcccatttcacagatgagaagtgtgaggtctggagaggagccacaacttgtttaaggtcacacaagctagtggatttgagaggctggggtggtcccgtattcacctctgttgctcccccaactccagagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagtccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327321 - DNA, 1898 bp, Homo sapiens
gacctctggacctctggtcccagccataagtggactgacctctctttatggccgtatccctgctgttctggatgctcctgggggcagtgcctatagctcagggtcatcctgagattcagctcctggagtctgagagttgtggccacagcgcagagggtccttggcgggggggcctgcgctgtccgctgcagcctgggctctgagcagtgctatccctagaccttactcaggggatcctctgaactctggccctgccctgcagcttgagctatttttgcacagctttgcggtgcatggcttttaaatggctccataagcagcaggctttctgcggtgatttttttttccatctcacgccgtatcccctccttgtctcccctcccctgtctccgagggtccatctctctgggtctcttcttgtctctcctcacctcctcccgacctttctgcccttcctcatctcttggggcctgaccctgcaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327322 - DNA, 461 bp, Homo sapiens
agcggctgaacggacgccgtagccgagaggttgggcggatgttgtgaaccgggtcgcggcggccgaggctcggggtgagtgaggggcggcagggctctgagcctggcgggttccggctattcccttcgcggtccagtttagtccagtgcgagggcacctgcagcgccgggatctgagtgcgaaactccgagcggaagctggtctggcaggtcctctggagcttggggccaggcgggggcgacttgggggagccatccttgggctcccagacggacctccaggaccactggctgcccatgagagacgaaggatggcatccaagggggccggcgtgtctttctcccgcaagagctgtaggctgacctcagatgctgagaaatccagggtcacagcattgtgcaggagaagctgctgaatgactacctgacgcctgcgacctatgaggtccgagctctatctac

SEQ ID NO: 327323 - DNA, 262 bp, Homo sapiens
aagccaggttcttctgctggagtgtgtgagtgaaatgagtctgctatgggcagggtcagggaaggcttcctggaggcaggtgccttggaagacgggaggatgtagctcatggctagaggagcagccagccaccttccctggagagagcagccccagcatcccctctgctcccgctccccttgtcctgaagggagaagagcaacctggtccacagcctgcaggtggcccagcagcaggccgaggagctgccgcaggagcggga

SEQ ID NO: 327324 - DNA, 158 bp, Homo sapiens
agcaggaggtggcacggcagggcctggagggctccctatgagtggcggagcaggcccaggaggcgctggagcaacagctccccacactgcaccatgagctcagttggctgcaggagcagctagcacaggtaggccaaactgtgtgtggggtggtctgg

SEQ ID NO: 327325 - DNA, 508 bp, Homo sapiens
tctgaactctggccctgccctgcagcttgagctatttttgcacagctttgcggtgcatggcttttaaatggctccataagcagcaggctttctgcggtgatttttttttccatctcacgccgtatcccctccttgtctcccctcccctgtctccgagggtccatctctctgggtctcttcttgtctctcctcacctcctcccgacctttctgcccttcctcatctcttggggcctgaccctgcaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccaggtacactgtgcacctgcgggcccacctaccttgcccacccgtcctccccactcagtgaggcaccctgggcccggccctgcacctgtcttggcccctgcctccctttctgtctctgg

SEQ ID NO: 327326 - DNA, 3036 bp, Homo sapiens
agcggctgaacggacgccgtagccgagaggttgggcggatgttgtgaaccgggtcgcggcggccgaggctcgggcctccaggaccactggctgcccatgagagacgaaggatggcatccaagggggccggcgtgtctttctcccgcaagagctgtaggctgacctcagatgctgagaaatccagggtcacaggcattgtgcaggagaagctgctgaatgactacctgaaccgcatctttcctcttctgaccatgcacccccagcagccaccggcagttactcgggaggctgaggcaggagaatcgcttgaaccggagaggcggacgttgcagtgagccgaggtcaaaccagtgcactccagcctgggcaacagagcgagactccatctgaaaaagaaacaaaaacaaaaaaaaattttggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagtccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327327 - DNA, 2796 bp, Homo sapiens
agcggctgaacggacgccgtagccgagaggttgggcggatgttgtgaaccgggtcgcggcggccgaggctcggggtgagtgaggggcggcagggctctgagcctggcgggttccggctattcccttcgcggtccagtttagtccagtgcgagggcacctgcagcgccgggatctgagtgcgaaactccgagcggaagctggtctggcagcctccaggaccactggctgcccatgagagacgaaggatggcatccaagggggccggcgtgtctttctcccgcaagagctgtaggctgacctcagatgctgagaaatccagggtcacaggcattgtgcaggagaagctgctgaatgactacctgaaccgcatctttcctcttctgaccatgcacccccagcagccaccggcagttactcgggaggctgaggcaggagaatcgcttgaaccggagaggcggacgttgcagtgagccgaggtcaaaccagtgcactccagcctgggcaacagagcgagactccatctgaaaaagaaacaaaaacaaaaaaaaattttggacccgctgcagctgggaggggagctgtccaggaggccggcctgggaatgagcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagtccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327328 - DNA, 2582 bp, Homo sapiens
agcggctgaacggacgccgtagccgagaggttgggcggatgttgtgaaccgggtcgcggcggccgaggctcgggttactcgggaggctgaggcaggagaatcgcttgaaccggagaggcggacgttgcagtgagccgaggtcaaaccagtgcactccagcctgggcaacagagcgagactccatctgaaaaagaaacaaaaacaaaaaaaaattttagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggggatcatgttcggacccccaggccagcccactgctgctccttggcactttcacggccctggcgtgtccccgtcatagtccttatcagtcccttgtatttacctggtcaccctccatctctgagggtatgggggccagatggctcttgctgccctgatgttttggggggtctgcctgggcccctcctggtgtgtcacacgcgtccagtcctggccccctaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327329 - DNA, 2950 bp, Homo sapiens
agcggctgaacggacgccgtagccgagaggttgggcggatgttgtgaaccgggtcgcggcggccgaggctcggggtgagtgaggggcggcagggctctgagcctggcgggttccggctattcccttcgcggtccagtttagtccagtgcgagggcacctgcagcgccgggatctgagtgcgaaactccgagcggaagctggtctggcagcctccaggaccactggctgcccatgagagacgaaggatggcatccaagggggccggcgtgtctttctcccgcaagagctgtaggctgacctcagatgctgagaaatccagggtcacaggcattgtgcaggagaagctgctgaatgactacctgaaccgcatctttcctcttctgaccatgcacccccagcagccaccggcagttactcgggaggctgaggcaggagaatcgcttgaaccggagaggcggacgttgcagtgagccgaggtcaaaccagtgcactccagcctgggcaacagagcgagactccatctgaaaaagaaacaaaaacaaaaaaaaattttggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaaggctgaggctggccgcatggagctcgagctctccgtgaccaagctgagggcagaggaggcctccctgcaggactccctgtccaagctgagcgccctcaacgagagccttgctcaggacaagttggatctgaactgccttgtcacccagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327330 - DNA, 2803 bp, Homo sapiens
agcggctgaacggacgccgtagccgagaggttgggcggatgttgtgaaccgggtcgcggcggccgaggctcggggtgagtgaggggcggcagggctctgagcctggcgggttccggctattcccttcgcggtccagtttagtccagtgcgagggcacctgcagcgccgggatctgagtgcgaaactccgagcggaagctggtctggcagcctccaggaccactggctgcccatgagagacgaaggatggcatccaagggggccggcgtgtctttctcccgcaagagctgtaggctgacctcagatgctgagaaatccagggtcacaggcattgtgcaggagaagctgctgaatgactacctgaaccgcatctttcctcttctgaccatgcacccccagcagccaccggcagttactcgggaggctgaggcaggagaatcgcttgaaccggagaggcggacgttgcagtgagccgaggtcaaaccagtgcactccagcctgggcaacagagcgagactccatctgaaaaagaaacaaaaacaaaaaaaaattttggacccgctgcagctgggaggggagctgtccaggaggccggcctgggaatgagcacaggcctgcggctggcagagagccgggtcgagccagccctggagaagcaggcccagctggaggagcagctgcgggacaaggtgctccacgagaaggacctgtcccagcagcagatgcaaagcgacctggacaaggctgacctcagtgccaggagggtccctggtgggtgctgcatgaggcaggcgtcactgcagaagagtgacagagctgggcctggcagtgaagcgtcttcagaagcagaatctggagaaggatcaggtcgacaaggacctcaccgagaagcttgaggccctggaatccctgcggctacaggagcaggcggccctggagacagaggatggagaggggctacagcggagcctaagggacctggcacaggccgtcctgtctgacgctgagagcggcagcctgcgtccaacagcgtccgaccgcagcctgcgggggctctcgggccagcggaccccgtctccaccgcggcgctcctcgccgggccgaggccgttcgccccgcagaggcccctccccggcctgctcagacgactccacgctcgcttgccctgattctctccgccctgcacttttgccagctgaaggtccagggagaagagcaacctggtccacagcctgcaggtggcccagcagcaggccgaggagctgccgcaggagcgggagaagctgcaggttgcccaggaggagctgcagcgccagcgggaccggctggaggaagagcaggaagaggcggtgcagaatggcgcacgggttcgccgggagcttgagcgcagccatagacaactagagcagctggaagggaagcgctcagtcctggccaaggagctggtggaggtgagggaggcgctgagccgcgccacgctgcaacgggacatgctgcaggccgagaagaccgaggtggccgaggcgctgaccaagctggaggaagaaaaggccacgctgcagggccggcagcggcaggcggagcaggaggccacagtggcgccggcagagcaggagtggctggaggagctgtggttggagcaggaggtggcacggcagggcctggagggctccctatgagtggcggagcaggcccaggaggcgctggagcaacagctccccacactgcaccatgagctcagttggctgcaggagcagctagcacaggaggcagcatggcgggagctggaggccgagcgggcccagctgcagagtcagctgcagcgtgagcaggaggagctgctggcccggcggaaggctgagaaggaacagctgagtgaggagattgctgccctgcagcaggagcatgacgagggcctcctcctggccgagagcgagaagcagcaggccttgtctctgaaggagtctgagaagatggcgctgtcagagaagttgatgggtacacggcacagcctggccaccatctccctggagatggagcggcagaaaccagatgcccagagccggcaggagcaggaccgggtaggcctgccgtcgtagggaggcttgcggagcaggagcgccctctctccaccgagctatcccgcggtttccagcatcccatctggcggactcctcttcctctctcttctcctactctgggtcttctatcctggtgttccttgaatgcctatcttccttttgtgcctcggaacctctcacgcctgccacaagttactcttttccttggtagttctgaactttaaataaggtaatgcctgtaagaatgccataaatgctcaataattgtcatctgttattattttcatcagtaacatcatctgaatcatcagtattgtctgcttttaacagctgcatttttcattgtccaaatatagtcacatacatttgaccattttataattattgaataataaatttgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagccttcagggaaaatgtccctagctctttactacatcagatcaaggactctggataattggcataacatcctggaatagctgaaacagagatattattctctgctctcctctgttgtctttgtcttttcacgtcttaataaaagtgctggtgacaagagtgtaaaaaaaaaaat

SEQ ID NO: 327331 - DNA, 2073 bp, Homo sapiens
ggcggggctctcggggccgctgccgccgccgccgccgcgcattgtgcagcaggcgggcccccgcgcggcagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattgaaactca

SEQ ID NO: 327332 - DNA, 1923 bp, Homo sapiens
aggataggaactggagttattgttaatgttacaggaagaacacattctcaaaggagaggggggtggtgggaaactttgattttcatagggttttcagtttcctctcaaatgggaggatgcagcagtgccgctacttaactgaacgtctcgacagtctgatggggcggccctcagccttccggagcagcagtgggactgacctgtccagtgaggaagaaacactgaaccagatggaatggcctttggggatggaaaaaccccagtttacgctcatctcttctctcagctaacttttgtggagccctgttcccaaactggcctgggccagagcaccgtggaggggtatttgttgtaaatggaaggtttcgaggcccgcctggaaatcctgaagggtgagacctgcagtgggctcaggagtctgcatttgtgggtgaccgagggggcctcccctccctctagagtccacactgtggagagcatcaggaagggaaaggcctgcatcttgtgctcagtgagctcatcgtctagtgaggaaggcatgtgtgaatctctggacaaggcagcgctgagctgttgtggactagtggtgcaggcaagggattacttctgaccaaggatggtgagaaggtttcccatacagactgacgtctggattgagctttgaagaagaaagccaggactggagcagacgacgaggagggaagagtttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatg

SEQ ID NO: 327333 - DNA, 2029 bp, Homo sapiens
ggcggggctctcggggccgctgccgccgccgccgccgcgcattgtgcagcaggcgggcccccgcgcggcagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacgcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattgaaactca

SEQ ID NO: 327334 - DNA, 1771 bp, Homo sapiens
ggcggggctctcggggccgctgccgccgccgccgccgcgcattgtgcagcaggcgggcccccgcgcggcagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatg

SEQ ID NO: 327335 - DNA, 1235 bp, Homo sapiens
agtgggcggtaactcaggcctgttgagacagaataacctgccccccaccgagctcttgctgggcgcctgcacacagtcagcttggccacagcagttgcaggagcactccctggacttccacgcagaacagtccctcgggagctccggggcttctcagagaactgcatttccaccgcctgcaccctattcacaccacatatggggtttgcctttgatgtggatggtaaggctgtgcttacccatgctttgtgattctctcctaccttttttttctttaaacatctcaggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattgaaactca

SEQ ID NO: 327336 - DNA, 1329 bp, Homo sapiens
ggcggggctctcggggccgctgccgccgccgccgccgcgcattgtgcagcaggcgggcccccgcgcggcagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggtgagtgctcctctccctccactctgcaggacagctcagactttcgttcatttgtgaaaccatgagcagcaccaggctttgcttcatttgccatcggcacacttaggacatttgtgtttgttgcttgctaaatactagaggaaaaacaaacaaacacaaagtaagagtatacaaagaagtaaaacatctgcaaggcacgggtgagtgatgtaatcagtccctccaccttctgaagggcctgggtctaagattgtgtgaagcc

SEQ ID NO: 327337 - DNA, 360 bp, Homo sapiens
catttatggagtaagagttcaaatggacagtttatctgttcaattctagcattgtgatgcaagtggtgtatcttaatttcaaactggaagttaatttgtagaagaaattaaaacctgttttgccttatctgaaacatcagaatggggtgaaaggggttgagaactgtgtttttgctttaaaactgatttttgttattattgttctagatggttgaaccactaagagagaaaatcagagatttagaaaaaaggtatgtgtactttttgtcttaaagtcaatagttaaaataagtttgtctcaattgagtaattaattctgtttgtttgctccaaactctgccaacctaaataaatgtctgt

SEQ ID NO: 327338 - DNA, 426 bp, Homo sapiens
ggtgcaggcaagggattacttctgaccaaggatggtgagaaggtttcccatacagactgacgtctggattgagctttgaagaagaaagccaggactggagcagacgacgaggagggaagagtgtgaggttaatgatagtggctttctgtttgatgtcggagaggcttcctgtactctcaaggcacacttcttccctcttagcctttaatgcagtttcctgtctttccctgcataccttgtcacctcaagagtaaagataatgatgaataatttgttgtgtaagatcacagcccatacagagttgtttatactctctttgaggaatgtagggtgaccctgtctgtgtaagcagaaatgcccgtgagtataagtcaggtggcagcaggctccaggtctagcacacctgagcgggctctgtggtgtcgt

SEQ ID NO: 327339 - DNA, 2323 bp, Homo sapiens
ggcggggctctcggggccgctgccgccgccgccgccgcgcattgtgcagcaggcgggcccccgcgcggcagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattgaaactcaaaaaaaaaaaagaaaaaaaaaacaaaaaacaaaaaaaaaaaaaaaaagagagggcggggccccctctataagaaatattaccccagaagagaggggcacaccaagaatatataagcagcggcccgcgcggcatcccatgtcacacaaccggcgggccccccaaatgaagcagacctggcaatcctaacacgcactgggctgcgggacaccccagtgtaccacaaacagccggacacaggcggaaacaccg

SEQ ID NO: 327340 - DNA, 1833 bp, Homo sapiens
gtgctgcaggtactctaaggatccccgtgtggttcttgctggacactagagagaaatcagagattagacaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattgaaactca

SEQ ID NO: 327341 - DNA, 233 bp, Homo sapiens
ttccagggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327342 - DNA, 450 bp, Homo sapiens
ggatcttaatagagcatacccctaccatctctgtatgatgccgttccctgtccgcacctgtgttctgtgtcgttttcgggcgtaactggcatctgtggagcgttccatttcctgtggaactccggagcgcggtggacagactgtgccgctgcaggaagctacaaagaggcggtcctgccgtttgcggagctttccctcttgcccccgggggctctgccctgcacagacagtgactgtggttctgagttgctccccatgtgagtgggccatgacctgcagggccaagggtgctgacccctgagagcttcccagggagaccttgaaacattggtgctgaggccaccacagcccagctcgggtgtctccttgggcagtggccacaagtgccttctgccggacctgtgtcttgtctcatggcattctttcacaccaggctctgatccgggtacc

SEQ ID NO: 327343 - DNA, 1838 bp, Homo sapiens
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327344 - DNA, 1812 bp, Homo sapiens
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327345 - DNA, 2085 bp, Homo sapiens
ctcacacacgcccctccctctcacacacgccccctccctctcacacacatcccctccctctcacacacgcctccctcctcacaccgaggcgcatggcggtgagcgtccttcgtttcctggattttatacagatggaatcatctctccttccagcttgcttttctcccctgaccatgctctgaggatgccgttccctgtccgcacctgtgttctgtgtcgttttcgggcgtaactggcatctgtggagcgttccatttcctgtggaactccggagcgcggtggacagactgtgccgctgcaggaagctacaaagaggcggtcctgccgtttgcggagctttccctcttgcccccgggggctctgccctgcacagacagtgactgtggttctgagttgctccccatcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327346 - DNA, 2100 bp, Homo sapiens
tcccctaggggacagagccttgcccagccagtgcctgtccacacagcaggatgagcatggccccaagatagtgcctcagcctccctagtagctgggattacaggcacccaccaccgcacccaggtaattttttttttttaatttttagtagagacgggtcttcaccatgttggccaggctggtctcaaactcctgacctcaaatgatccacctgcctcggcctcccaaagtactgggattacaggcatgagccaccacgcccagcccaggcagagttcttatgtacccccaatgagcctgcccgcctcagccatgcctgttgagggggtggggggggatgccctgtgggccggccatgccagcgggtacctgggaggtgggcagctctgggccacatccgagtacatccctctctgcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327347 - DNA, 2089 bp, Homo sapiens
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcttgcttttctcccctgaccatgctctgaggatgccgttccctgtccgcacctgtgttctgtgtcgttttcgggcgtaactggcatctgtggagcgttccatttcctgtggaactccggagcgcggtggacagactgtgccgctgcaggaagctacaaagaggcggtcctgccgtttgcggagctttccctcttgcccccgggggctctgccctgcacagacagtgactgtggttctgagttgctccccatcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327348 - DNA, 2547 bp, Homo sapiens
gtcctgctgcggggggttcactctgtagccccaggcaggccggggtactgtagctttttccaggggatccaggaggggtgcaggcacacggcgcacagtggtcctccgcaggcctgcggtcctaggctggccgaatgtgccagcccacacacaggagggggcagttcacaccgagggctggcccgaggattgtcagggccacaccaggcaaagccagcgctattaatatcaggcatacacaagcccccagctgggtgatcctcttatgcctgtggccttggcctctgaggacggcagtgagtgctgttccctcagtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgggcccccgcccagctcccccgaggacccctttgtcctctccctgaccctggaccccctgcaaaagtaggtccctggtctcagccccagcgtggctgctcctgggaggcctagagcccctgtccgctggcattgggtgagggccctactgtgcccacagctgctccacagcctcccccaccaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327349 - DNA, 2732 bp, Homo sapiens
gtcctgctgcggggggttcactctgtagccccaggcaggccggggtactgtagctttttccaggggatccaggaggggtgcaggcacacggcgcacagtggtcctccgcaggcctgcggtcctaggctggccgaatgtgccagcccacacacaggagggggcagttcacaccgagggctggcccgaggattgtcagggccacaccaggcaaagccagcgctattaatatcaggcatacacaagcccccagctgggtgatcctcttatgcctgtggccttggcctctgaggacggcagtgagtgctgttccctcagtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggtgagagcagcgggggggtgggacctgctgccggacgcctgcctccggctcccctccagtgcctgtggagcaggagaaggaagccgggcaaccgcaggcagcggcagcgggatgggcacctctgggacctatctgtgccggcagcctgcctgttcctcacagagggtctccactcccgccggcaggcttgggaggcggcagtgcctctgggaagaccactgtggccagaatgatcatcgaggccctggatgtgccctgggtggtcttgctgtccatggactccttctacaaggtgggcccccgcccagctcccccgaggacccctttgtcctctccctgaccctggaccccctgcaaaagtaggtccctggtctcagccccagcgtggctgctcctgggaggcctagagcccctgtccgctggcattgggtgagggccctactgtgcccacagctgctccacagcctcccccaccaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327350 - DNA, 1481 bp, Homo sapiens
ctccctgtcccacctctttcttgcctccaccccgcccttttcctgcccgctcctagacctgctgctgccccggccatccccaggcttgggcagcggggcgggacgggacagccaagagacactgagccagctttgccccccacccccctctcttgaggggccgcgcaccacctcggggaggagccagggcggggcctgaccccacaaagctttagttcccccggggagaggctggggacaagctacccattctggggtatgacacctatcagcacgtgtgagcccgccctgtgcccggcccacttctgcttcctcttagcgcaggaggggtcccgcactgggaggggccctcacagcctaccccgctagctttctgcctgatggtgagcttgccccgttgttcgccgccatctttcgcctttgcctgacagctcaggtagggcgacgtctccccccagctcagccccaggcagaagtcaggcccgctctgcacctcgtgctgtgcctggcccgtgtgttcccctcacagtgacgcacagccgtcctgtggggagggagggctctgggaaaagacccccttcttgagtgttccccatcggtttgtcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327351 - DNA, 1455 bp, Homo sapiens
ctccctgtcccacctctttcttgcctccaccccgcccttttcctgcccgctcctagacctgctgctgccccggccatccccaggcttgggcagcggggcgggacgggacagccaagagacactgagccagctttgccccccacccccctctcttgaggggccgcgcaccacctcggggaggagccagggcggggcctgaccccacaaagctttagttcccccggggagaggctggggacaagctacccattctggggtatgacacctatcagcacgtgtgagcccgccctgtgcccggcccacttctgcttcctcttagcgcaggaggggtcccgcactgggaggggccctcacagcctaccccgctagctttctgcctgatggtgagcttgccccgttgttcgccgccatctttcgcctttgcctgacagctcaggtagggcgacgtctccccccagctcagccccaggcagaagtcaggcccgctctgcacctcgtgctgtgcctggcccgtgtgttcccctcacagtgacgcacagccgtcctgtggggagggagggctctgggaaaagacccccttcttgagtgttccccatcggtttgtcgtcagggctgcgctggcctcggcacaccagtgccacccgctgccccggacgctgagcgtcctgaagagcacgccgcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327352 - DNA, 1582 bp, Homo sapiens
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgaggtgcctgggggcagccggggtgatgagcccgggggtagggggcagagggagctcacagcaaggggacgcagggagccccacctgcagcctgacccctgctgcccgcagctccactacctgaggctgcccaaggacatcagcgatgaccacgtgatcctcatggactgcaccgtgtccacgggcgcggcggccatgatggcagtgcgcgtgctcctgtcgtgagtgagcctctgggt

SEQ ID NO: 327353 - DNA, 611 bp, Homo sapiens
atggactgcaccgtgtccacgggcgcggcggccatgatggcagtgcgcgtgctcctgtcgtgagtgagcctctgggtaggcggggcaggttcaggcagaggtgggatttacctgcccaatacactcggtaggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattggtgaggctgcccgggcccttcagccgcacatgagggcagggtgggtggccctgggaggccccaccacactggacccccccccccctttttccagggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaaaa

SEQ ID NO: 327354 - DNA, 2287 bp, Homo sapiens
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaaaaggtgtgattggttacagcacaggagaggtgtcctggctgaggcatgcatttgtggagactcccatggggagggagggagggagctgagggccctgccttctcccctgcaggaccaagcattcccagtcttgcacttgtgccagatgaaggaaggggtagaactgggccctgcagctcctagctctgctagatggggcccctagaacccatagcttggtggccacctggcctggacctagggaggggacagggccccctggtgctctgggtctcacaagaggcaggctgttttgcccccacccacaaatttgtaccatcagggtcctccccacagttggggggggggagggtccttcccgtcaggacaagtcgctggaggcagcaaagccaggaggcagaccagggcggaagtgggggcctgcgcttggaggcggggccacccggggc

SEQ ID NO: 327355 - DNA, 1915 bp, Homo sapiens
  misc_feature (1905)..(1905): n is a, c, g, or t
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttattctaaagtttctctcttccttctttatcaacttacaagacaagtttattgaattacgtgcatgcaggagcatttctggtctttccatgagcagcnagagccaagt

SEQ ID NO: 327356 - DNA, 2362 bp, Homo sapiens
gtcctgctgcggggggttcactctgtagccccaggcaggccggggtactgtagctttttccaggggatccaggaggggtgcaggcacacggcgcacagtggtcctccgcaggcctgcggtcctaggctggccgaatgtgccagcccacacacaggagggggcagttcacaccgagggctggcccgaggattgtcagggccacaccaggcaaagccagcgctattaatatcaggcatacacaagcccccagctgggtgatcctcttatgcctgtggccttggcctctgaggacggcagtgagtgctgttccctcagtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327357 - DNA, 2042 bp, Homo sapiens
tcccctaggggacagagccttgcccagccagtgcctgtccacacagcaggatgagcatggccccaagatagtgcctcagcctccctagtagctgggattacaggcacccaccaccgcacccaggtaattttttttttttaatttttagtagagacgggtcttcaccatgttggccaggctggtctcaaactcctgacctcaaatgatccacctgcctcggcctcccaccccctcaacaggcatggctgaggcgggcaggctcattgggggtggggggggatgccctgtgggccggccatgccagcgggtacctgggaggtgggcagctctgggccacatccgagtacatccctctctgcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327358 - DNA, 2227 bp, Homo sapiens
tcccctaggggacagagccttgcccagccagtgcctgtccacacagcaggatgagcatggccccaagatagtgcctcagcctccctagtagctgggattacaggcacccaccaccgcacccaggtaattttttttttttaatttttagtagagacgggtcttcaccatgttggccaggctggtctcaaactcctgacctcaaatgatccacctgcctcggcctcccaccccctcaacaggcatggctgaggcgggcaggctcattgggggtggggggggatgccctgtgggccggccatgccagcgggtacctgggaggtgggcagctctgggccacatccgagtacatccctctctgcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgggcccccgcccagctcccccgaggacccctttgtcctctccctgaccctggaccccctgcaaaagtaggtccctggtctcagccccagcgtggctgctcctgggaggcctagagcccctgtccgctggcattgggtgagggccctactgtgcccacagctgctccacagcctcccccaccaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327359 - DNA, 2547 bp, Homo sapiens
gtcctgctgcggggggttcactctgtagccccaggcaggccggggtactgtagctttttccaggggatccaggaggggtgcaggcacacggcgcacagtggtcctccgcaggcctgcggtcctaggctggccgaatgtgccagcccacacacaggagggggcagttcacaccgagggctggcccgaggattgtcagggccacaccaggcaaagccagcgctattaatatcaggcatacacaagcccccagctgggtgatcctcttatgcctgtggccttggcctctgaggacggcagtgagtgctgttccctcagtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggtgagagcagcgggggggtgggacctgctgccggacgcctgcctccggctcccctccagtgcctgtggagcaggagaaggaagccgggcaaccgcaggcagcggcagcgggatgggcacctctgggacctatctgtgccggcagcctgcctgttcctcacagagggtctccactcccgccggcaggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327360 - DNA, 2301 bp, Homo sapiens
gtcctgctgcggggggttcactctgtagccccaggcaggccggggtactgtagctttttccaggggatccaggaggggtgcaggcacacggcgcacagtggtcctccgcaggcctgcggtcctaggctggccgaatgtgccagcccacacacaggagggggcagttcacaccgagggctggcccgaggattgtcagggccacaccaggcaaagccagcgctattaatatcaggcatacacaagcccccagctgggtgatcctcttatgcctgtggccttggcctctgaggacggcagtgagtgctgttccctcagtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327361 - DNA, 1859 bp, Homo sapiens
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagcctgacccctgctgcccgcagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327362 - DNA, 1946 bp, Homo sapiens
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgaggtgcctgggggcagccggggtgatgagcccgggggtagggggcagagggagctcacagcaaggggacgcagggagccccacctgcagcctgacccctgctgcccgcagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327363 - DNA, 937 bp, Homo sapiens
ttgtgtgcgcgtcggttgttgcgcgtgctgcacaattcagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttagaaaaatgaa

SEQ ID NO: 327364 - DNA, 656 bp, Homo sapiens
gaaaataggagaatttactttcatttcccaagactatatagcctgtcctctagtttccagcagtgagagagagaaagcgagcggtctccagtacagtgccgtagactctccattagaccctctcaggttgacaaagattagttcatctgaatcctagagtagggtagtttagctgtgagtttgcctaaaaccatggttctcaaacttcagcaggcatgaagccgggtgctgtggctcacactgaggtggggggattgcttgagcccaggagttcaagaccagcctgggcaacatagcaaaacccccatctctaaaaatgaaaagaaacgctttagcagacatggcatgagaatcacctagagggctgcaataccagagattctgattcagtagccctggggtaaggtccaagtgcttgcatttctaacaagctcctaagagctgatgctactggcctctgggggccacactttgagaccctgaaagcctaaaggatcatgcagttcatctaaatctgtgtcaccaccttatgtctaaaagctactgctggccgggcatggtggctcacgcctgtaatcccaacactttggaaggccgaggcaggtagatcacttgaggtcaggagttcgagaccagcctgaccaacatggtgaaac

SEQ ID NO: 327365 - DNA, 370 bp, Homo sapiens
ctcaaggataagagaggctccaagatggagtggactccatctaggccatgttgcctggaaaagctggaagaggcccctgtagagtgagcagtgattgagaggcaggccatggggactgagcaggggcggggccagagtgtttgggaagcatgtctgtcagcagagggttcttagggagaattggactggggagtcaggaggggtaagagccaaagactgggacttgggaatagcccatctttgagggaaaggcaggggaggagccagggaacacctgcctcctttggaatctgcaaatgcaggtccttctggctggaaagatagaggcaccttagagactgttgctgtgaggacatcttttcttttccct

SEQ ID NO: 327366 - DNA, 637 bp, Homo sapiens
ctgataccattcagctcggtacccacaccacctgagtccagcagtgagagagagaaagcgagcggtctccagtacagtgccgtagactctccattagaccctctcaggttgacaaagattagttcatctgaatcctagagtagggtagtttagctgtgagtttgcctaaaaccatggttctcaaacttcagcaggcatgaagccgggtgctgtggctcacactgaggtggggggattgcttgagcccaggagttcaagaccagcctgggcaacatagcaaaacccccatctctaaaaatgaaaagaaacgctttagcagacatggcatgagaatcacctagagggctgcaataccagagattctgattcagtagccctggggtaaggtccaagtgcttgcatttctaacaagctcctaagagctgatgctactggcctctgggggccacactttgagaccctgaaagcctaaaggatcatgcagttcatctaaatctgtgtcaccaccttatgtctaaaagctactgctggccgggcatggtggctcacgcctgtaatcccaacactttggaaggccgaggcaggtagatcacttgaggtcaggagttcgagaccagcctgaccaacatggtgaaac

SEQ ID NO: 327367 - DNA, 470 bp, Homo sapiens
gggagtcaggaggggtaagagccaaagactgggacttgggaatagcccatctttgagggaaaggcaggggaggagccagggaacacctgcctcctttggaatctgcaaatgcaggtccttctggctggaaagatagaggcaccttagagactgttgctgtgaggacatcttttcttttcccttgtccagtcctgtaatgatgtgggaaacaaagcacagatagtgtaccagctgcccaatagaggaaaataggagaatttactttcatttcccaagactatatagcctgtcctctagtttccagcagtgagagagagaaagcgagcggtctccagtacagtgccgtagactctccattagaccctctcaggttgacaaagattagttcatctgaatcctagagtagggtagtttagctgtgagtttgcctaaaaccatggttctcaaacttcagcaggcatgaagccggg

SEQ ID NO: 327368 - DNA, 1432 bp, Homo sapiens
  misc_feature (24)..(24): n is a, c, g, or t
gcttgatgcgctcgcaatggctgncgcagcactgtctccgtctgcacgcacacacctgacacctctttgggctctgaactgctttctctcatcaagcatgctagcactctagacagaattctagaaatttggcagacagtggaagcctttaattgaacttactccttcgttgactgaaaggagttttaaattctgagctcctgagatactgactagcaaccatggaatgaatgtgtgaccagaaagtggctttgacaccaagtgctactgtccctttgtaattggcttctaacagattcaaccagaaataattgataatgtgaatttttgttaattgttcacttgtaggaaaatagaacatgtatcaccctttgttaggtagacatgaacttttcctgcacaaagccttgcttttagagaatgcccaataaggcaagaaaaagcatagtaacttgtgctttgagagctcaatatttgtatcttatcagtacagaagaaatatttctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgaccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgta

SEQ ID NO: 327369 - DNA, 7014 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327370 - DNA, 4394 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327371 - DNA, 3726 bp, Homo sapiens
gcgccctggtgccaggcgctcagctcggcgctcccctgtgctcgcccggcgcccactcattcgcagcccggccttcgtcgccgccgcctccctgctgctcctcctcctttccccagcccgccgcggccatggcggacagcgccagcgagagcgacacggacggggcggggggcaacagcagcagctcggccgccatgcagtcgtcctgctcgtcgacctcgggcggcggcggtggcggcgggggaggcggcggcggtgggaagtcggggggcattgtcatctcgccgttccgcctggaggagctcaccaaccgcctggcctcgctgcagcaagagaacaaggtgctgaagatagagctggagacctacaaactgaagtgcaaggcactgcaggaggagaaccgcgacctgcgcaaagccagcgttaccatcgaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327372 - DNA, 691 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccgggggcagcattgtttggcgcggagcactgatgcccttgggcgaagccccccgagggggactttacacaggctttgggcttattttggcaactccttggctatatcttggcttttccccctttggaacgggaaggcgaccgccacacacgggttggcgcttttccagggacgggaaggtccccccg

SEQ ID NO: 327373 - DNA, 5705 bp, Homo sapiens
gcgccctggtgccaggcgctcagctcggcgctcccctgtgctcgcccggcgcccactcattcgcagcccggccttcgtcgccgccgcctccctgctgctcctcctcctttccccagcccgccgcggccatggcggacagcgccagcgagagcgacacggacggggcggggggcaacagcagcagctcggccgccatgcagtcgtcctgctcgtcgacctcgggcggcggcggtggcggcgggggaggcggcggcggtgggaagtcggggggcattgtcatctcgccgttccgcctggaggagctcaccaaccgcctggcctcgctgcagcaagagaacaaggtgctgaagatagagctggagacctacaaactgaagtgcaaggcactgcaggaggagaaccgcgacctgcgcaaagccagcgttaccatccaagccagggctgagcaggaagaagaattcattagtaacactttattcaagaaaattcaggctttgcagaaggagaaagaaacccttgctgtaaattatgagaaagaagaagaattcctcactaatgagctctccagaaaattgatgcagttgcagcatgagaaagccgaactagaacagcatcttgaacaagagcaggaatttcaggtcaacaaactgatgaagaaaattaaaaaactggagaatgacaccatttctaagcaacttacattagaacagttgagacgggagaagattgaccttgaaaatacattggaacaagaacaagaagcactagttaatcgcctctggaaaaggatggataagcttgaagctgaaaagcgaatcctgcaggaaaaattagaccagcccgtctctgctccaccatcgcctagagatatctccatggagattgattctccagaaaatatgatgcgtcacatcaggtttttaaagaatgaagtggaacggctgaagaagcaactgagagctgctcagttacagcattcagagaaaatggcacagtatctggaggaggaacgtcacatgagagaagagaacttgaggctccagaggaagctgcagagggagatggagagaagagaagccctctgtcgacagctctccgagagtgagtccagcttagaaatggacgacgaaaggtattttaatgagatgtctgcacaaggattaagacctcgcactgtgtccagcccgatcccttacacaccttctccgagttcaagcaggcctatatcacctggtctatcatatgcaagtcacacggttggtttcacgccaccaacttcactgactagagctggaatgtcttattacaattccccgggtcttcacgtgcagcacatgggaacatcccatggtatcacaaggccttcaccacggagaagcaacagtcctgacaaattcaaacggcccacgccgcctccatctcccaacacacagaccccagtccagccacctccacctccacctccgccacccatgcagcccacggtcccctcagcagccacctcgcagcctactccttcgcaacattcggcgcacccctcctcccagccttaatgcatgagcttagtctgaatttcaagttgggactcatccaatggagccgtctactcaacgccaaaggcttccttctctggcatatttggatatgacttatttgcactgaggttatctaggcttcactatccattgtgttgtaaatgtttgtcagaaatgcagccagtgttgtgggtctacaacactaaccagacgactttttccatcagtgttttacttgaatcttcatgtacgtccattccctggctggaaccttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtggaacactgagtcactcttttcttaacacgtgcaacatcttaatttttgtttttcagcagttgctgttttgtactttggtagtgaagtgatttttaccacctgtgtttgcatatttatatatgctgtggatgaaaataacttactagagaatgtatattttatgacaagaatgtgtatctgttggatataatcagagaactgaaaagtaatttatcagtaatttttaagagtccatgttttgtgacaaccatctctaatagccaactctttattaaacacactcctaaaaataaggaaccatgacattgtagatatttaatattgtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccatcctgcaggcaggtgggagcaacaggggcttcagtagcttcattttcctgtcttgcagacagagacccttggctaccactgtgctgctaataggataagtactctgttgccagattaccatgccttttatacaaaaccaaattaacttacctaatacctgacacctctttgggctctgaactgctttctctcatcaagcatgctagcactctagacagaattctagaaatttggcagacagtggaagcctttaattgaacttactccttcgttgactgaaaggagttttaaattctgagctcctgagatactgactagcaaccatggaatgaatgtgtgaccagaaagtggctttgacaccaagtgctactgtccctttgtaattggcttctaacagattcaaccagaaataattgataatgtgaatttttgttaattgttcacttgtaggaaaatagaacatgtatcaccctttgttaggtagacatgaacttttcctgcacaaagccttgcttttagagaatgcccaataaggcaagaaaaagcatagtaacttgtgctttgagagctcaatatttgtatcttatcagtacagaagaaatatttctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgaccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgta

SEQ ID NO: 327374 - DNA, 4716 bp, Homo sapiens
ttgagctgtatctttcaggatgtggacaacttattggagataagcaatagagggaattggtgacacacacggaaagaaagatttaaggggatattttacagctctcgttgaaggacccaagtccagcagtttgttctacacaagttgtgcagtaattttatgtagctttttcataggtggaagtgtaaacactgccttatttaaattttattactagttcagaaaccagtagggatgaagaaagaaatccctggtttcttgtctttgttggttagtgtttgattagccccagtgccaagtcaggctgtgttaggtagaatgagatccacctgtacctagactgacttgctgttcctgtcccctctgcagaggccttcaccacggagaagcaacagtcctgacaaattcaaacggcccacgccgcctccatctcccaacacacagaccccagtccagccacctccacctccacctccgccacccatgcagcccacggtcccctcagcagccacctcgcagcctactccttcgcaacattcggcgcacccctcctcccagccttaatgcatgagcttagtctgaatttcaagttgggactcatccaatggagccgtctactcaacgccaaaggcttccttctctggcatatttggatatgacttatttgcactgaggttatctaggcttcactatccattgtgttgtaaatgtttgtcagaaatgcagccagtgttgtgggtctacaacactaaccagacgactttttccatcagtgttttacttgaatcttcatgtacgtccattccctggctggaaccttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtggaacactgagtcactcttttcttaacacgtgcaacatcttaatttttgtttttcagcagttgctgttttgtactttggtagtgaagtgatttttaccacctgtgtttgcatatttatatatgctgtggatgaaaataacttactagagaatgtatattttatgacaagaatgtgtatctgttggatataatcagagaactgaaaagtaatttatcagtaatttttaagagtccatgttttgtgacaaccatctctaatagccaactctttattaaacacactcctaaaaataaggaaccatgacattgtagatatttaatattgtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccatcctgcaggcaggtgggagcaacaggggcttcagtagcttcattttcctgtcttgcagacagagacccttggctaccactgtgctgctaataggataagtactctgttgccagattaccatgccttttatacaaaaccaaattaacttacctaatacctgacacctctttgggctctgaactgctttctctcatcaagcatgctagcactctagacagaattctagaaatttggcagacagtggaagcctttaattgaacttactccttcgttgactgaaaggagttttaaattctgagctcctgagatactgactagcaaccatggaatgaatgtgtgaccagaaagtggctttgacaccaagtgctactgtccctttgtaattggcttctaacagattcaaccagaaataattgataatgtgaatttttgttaattgttcacttgtaggaaaatagaacatgtatcaccctttgttaggtagacatgaacttttcctgcacaaagccttgcttttagagaatgcccaataaggcaagaaaaagcatagtaacttgtgctttgagagctcaatatttgtatcttatcagtacagaagaaatatttctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgaccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgta

SEQ ID NO: 327375 - DNA, 6954 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327376 - DNA, 5362 bp, Homo sapiens
cagatccagttgttctcatgcagccgtgtgcggtacgtgccgtagagatgctggcccaggcggaagctgggcacctccttactgtacttccataccctatggaagtacagtaaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327377 - DNA, 5680 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327378 - DNA, 4861 bp, Homo sapiens
tctcacctccggacgtgagaattacaggcttggatctcaaaccgccgcggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaggccttacagagtgaaaaatcacgaataatgcaggatcaaagtgaaggtaacagcctgcagaatcaagctctgcagactcttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattgaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327379 - DNA, 5041 bp, Homo sapiens
cagccccacgccggctgcagctccgcgagccgagccggatctcgagcggggtacacgggctgaggcggcggcggcggccccgcccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327380 - DNA, 5171 bp, Homo sapiens
gcgccctggtgccaggcgctcagctcggcgctcccctgtgctcgcccggcgcccactcattcgcagcccggccttcgtcgccgccgcctccctgctgctcctcctcctttccccagcccgccgcggccatggcggacagcgccagcgagagcgacacggacggggcggggggcaacagcagcagctcggccgccatgcagtcgtcctgctcgtcgacctcgggcggcggcggtggcggcgggggaggcggcggcggtgggaagtcggggggcattgtcatctcgccgttccgcctggaggagctcaccaaccgcctggcctcgctgcagcaagagaacaaggtgctgaagatagagctggagacctacaaactgaagtgcaaggcactgcaggaggagaaccgcgacctgcgcaaagccagcgttaccatcatactggagaacaggccatctgttctgtttctacctgtcccctggaggctgcccagaaaccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327381 - DNA, 363 bp, Homo sapiens
aaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcgttcagtggcatcaacgtccagtacaagctgcattcctctggtgccaactg

SEQ ID NO: 327382 - DNA, 5626 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327383 - DNA, 4220 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatgatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327384 - DNA, 699 bp, Homo sapiens
  misc_feature (682)..(682): n is a, c, g, or t
ccgcttcgtccataggatagtgtctcacggcagctcaggcagcggaacctggggctctcctggtttggaagctggttgcataacagcccagaggactacagccctggaggacccgggtccgcattcttatccaggctgatgggagcaagatcgcgcatcttgctcccatcaggtttttaaagaatgaagtggaacggctgaagaagcaactgagagctgctcagttacagcattcagagaaaatggcacagtatctggaggaggaacgtctgatgggagtcttgctcccatcagcaacataacattcccccctgggtggttcttaacctgtgtggggactccaggcccagctacttaacaaaatggggataatgaggcttgcagagcaggcagactgatgggagaagactggcgcagtcttcttcccatcagaaaaaaatgggttccttgctgtcccagtaaggcatagcttttccagccctaactttaaaactcagtgaggacttagatgggaaagaatgaggtaaatacaaaggattgcaggacaacaactacagcgttgtgtactgtgggaaggggagttgggcactcttggaggactcctgctgaaggtggtcagcctgcctgacaattggagacatacttgaatggggagcagggtatgtgctttcatatgaaaaangagctgatgggagcaag

SEQ ID NO: 327385 - DNA, 4460 bp, Homo sapiens
gcgccctggtgccaggcgctcagctcggcgctcccctgtgctcgcccggcgcccactcattcgcagcccggccttcgtcgccgccgcctccctgctgctcctcctcctttccccagcccgccgcggccatggcggacagcgccagcgagagcgacacggacggggcggggggcaacagcagcagctcggccgccatgcagtcgtcctgctcgtcgacctcgggcggcggcggtggcggcgggggaggcggcggcggtgggaagtcggggggcattgtcatctcgccgttccgcctggaggagctcaccaaccgcctggcctcgctgcagcaagagaacaaggtgctgaagatagagctggagacctacaaactgaagtgcaaggcactgcaggaggagaaccgcgacctgcgcaaagccagcgttaccatccaagccagggctgagcaggaagaagaattcattagtaacactttattcaagaaaattcaggctttgcagaaggagaaagaaacccttgctgtaaattatgagaaagaagaagaattcctcactaatgagctctccagaaaattgatgcagttgcagcatgagaaagccgaactagaacagcatcttgaacaagagcaggaatttcaggtcaacaaactgatgaagaaaattaaaaaactggagaatgacaccatttctaagcaacttacattagaacagttgagacgggagaagattgaccttgaaaatacattggaacaagaacaagaagcactagttaatcgcctctggaaaaggatggataagcttgaagctgaaaagcgaatcctgcaggaaaaattagaccagcccgtctctgctccaccatcgcctagagatatctccatggagattgattctccagaaaatatgatgcgtcacatcaggtttttaaagaatgaagtggaacggctgaagaagcaactgagagctgctcagttacagcattcagagaaaatggcacagtatctggaggaggaacgtcacatgagagaagagaacttgaggctccagaggaagctgcagagggagatggagagaagagaagccctctgtcgacagctctccgagagtgagtccagcttagaaatggacgacgaaaggtattttaatgagatgtctgcacaaggattaagacctcgcactgtgtccagcccgatcccttacacaccttctccgagttcaagcaggcctatatcacctggtctatcatatgcaagtcacacggttggtttcacgccaccaacttcactgactagagctggaatgtcttattacaattccccgggtcttcacgtgcagcacatgggaacatcccatggtatcacaaggccttcaccacggagaagcaacagtcctgacaaattcaaacggcccacgccgcctccatctcccaacacacagaccccagtccagccacctccacctccacctccgccacccatgcagcccacggtcccctcagcagccacctcgcagcctactccttcgcaacattcggcgcacccctcctcccagccttaatgcatgagcttagtctgaatttcaagttgggactcatccaatggagccgtctactcaacgccaaaggcttccttctctggcatatttggatatgacttatttgcactgaggttatctaggcttcactatccattgtgttgtaaatgtttgtcagaaatgcagccagtgttgtgggtctacaacactaaccagacgactttttccatcagtgttttacttgaatcttcatgtacgtccattccctggctggaaccttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtggaacactgagtcactcttttcttaacacgtgcaacatcttaatttttgtttttcagcagttgctgttttgtactttggtagtgaagtgatttttaccacctgtgtttgcatatttatatatgctgtggatgaaaataacttactagagaatgtatattttatgacaagaatgtgtatctgttggatataatcagagaactgaaaagtaatttatcagtaatttttaagagtccatgttttgtgacaaccatctctaatagccaactctttattaaacacactcctaaaaataaggaaccatgacattgtagatatttaatattgtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccatcctgcaggcaggtgggagcaacaggggcttcagtagcttcattttcctgtcttgcagacagagacccttggctaccactgtgctgctaataggataagtactctgttgccagattaccatgccttttatacaaaaccaaattaacttacctaatacctgacattcttggtcagagtttagagagatgtaagactttcaattaatgtcttatttactcctttatgttgattagtctttgatacatgtgctgaatcagaaacctaaataaagataattttttaaaatgta

SEQ ID NO: 327386 - DNA, 4164 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattt

SEQ ID NO: 327387 - DNA, 5958 bp, Homo sapiens
caggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgccccaaaatgtctattcttgacggagagtctaaagcagttcacagaaaaaatgcagtcagatatggagaaaatccaagaattaagagaggctcagttatactcagggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327388 - DNA, 5340 bp, Homo sapiens
cagagaaccatggagtctggcagtaccgccgccagtgaggaggcacgcagccttcgagaatgtgagctctacgtccagaagcataacattcaagcactgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttatggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtg

SEQ ID NO: 327389 - DNA, 3085 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccaggttcggatcccgtttcactggtggcattgactcctttgaccattttatccacgcaagtgttgttggtctttggccctgcgggggaatccggccctggggaacccatctggattccctgggggtcccttagacgccggtggggcgccactgcggtttcccg

SEQ ID NO: 327390 - DNA, 247 bp, Homo sapiens
atcattctttatttttttgtctataaatcttcttccaccacgtggctgcgctggagtctctgtgaatctgctgtgattctgggcctgcccaatttgcaaatcgttcattgctcaattaaactcctttaaatgtaattcggctgaagtttttattttatcacaaggcttagtgtttcccaatccacagatgtctctgttgttgtactgctgaaatttgcagttaaagttgagaaaatttgttaaatat

SEQ ID NO: 327391 - DNA, 496 bp, Homo sapiens
ccttcccaatgttcctagtgcttgtttctgagaaatggctcattcagtggccggttcaaagcattcttgctgcttaaattaagctcttaggtgacctcaactcttcttctagaagagtgtcacatttgtctttcatgaactttccatgaagatacagttggagaaaccaaaagaatagaaggaggggcctcaccaagcttacaggacaggatgtatgattgtttttattcctgcttactaatcaaacttggattgtgagggtgaatcgaacccgagaccaagtgttgaggctgtgaggatggtttctttatcctcacccacctccaaattctggagtttttaacatccactgagagggacctggtagatatgaaggaccaggttagctgaggttggtttttagcatggcagggatgggacagaagagtttggggaaggttcctcaagcatccatcacggaagggacaagaagggagagagagtggatgccagggac

SEQ ID NO: 327392 - DNA, 117 bp, Homo sapiens
agtgctggataaaaggctgactttgaaactgctctacagagacctaattttcttgctgtttttaaagacaaaggcatcctcacatctggcacggaggtagacctgagcaagccaggg

SEQ ID NO: 327393 - DNA, 421 bp, Homo sapiens
tcacagccaagcggatgcaagagctcaaccagcacgtggcttccatcccacacagggcctccgcacgcacagctcgagagggcaccatcccgtcaaagctcaacagaacagcgcctcctggagtggggcagtgaacagcctgcccagcaaacaacgacagaagcataagcaatggccacatccccacatcttttctctaccttcatgttccccctttcggcattaagacgttagatacttggccaggtgtggtggctcatgcctgtaatcccagcactttgggaggccgaggctggcagatcacaaccaggatggagatcaagaccatcctgactaacacggtgaaacctcatctctactaaaaatacaaaaaattagccaggagtggtggcaggtgcctgtagtcccagctactcgggag

SEQ ID NO: 327394 - DNA, 402 bp, Homo sapiens
ttccctttcatgtgatgaactataccacagaaaagaaactggagagagtaaaaaaaatttgacaacaaaaggttttcatctactgctgattcagcactgacataaggaggaagaatcctcaggaggcacttgcttcatcaatttagtcaaaactgcaacctgtcaaaataattcattagtgaagaaaatttgtttctctcagctaccttctccaagggaaatcacaatatggaaagtgttactaccttttaaacttgttctaaaatcttccaaaagttactgattggaactctctagtttcaaatcgattatctcaaacagaaactcctcacaatagtcttaatttcagttaattttctttctatggagaaatcctgcaataatttcaaagccatcctttta

SEQ ID NO: 327395 - DNA, 438 bp, Homo sapiens
catcatgtcagcattaagagtcttagataagttaacaaggtacattctttctaatatctttcaagtctaacatgtattgactgcatactatgtgttccactgttctaattatcatctttaattctcaaaactattgaggcaggtgctattattattgaaatataaatgagaaaatggagatatagagatcatagagctactaagtagcatgttaaaattaggatctagagcttgtcctcttaactattaggcgatgctctgtctcagtgagtgacacatcttgtatatcatggagatattttgttaaatgattttattatttgtaaaacacacattatgtctaaccattatttcactagtaattattttagaaggattaaattatacttattctcttgggacaataatttaaaaatttcaaatttaggttggtaaagt

SEQ ID NO: 327396 - DNA, 971 bp, Homo sapiens
caggctccaatggggcggggcttctctccgcgggtgggactcttccctgggaaccgccctcctgattaaggcgtggcttctgcaggaatcccggctccagagcaggaaattcagcccaccagccacctcatccccaaccccctgtaaggttccatccacccctgcgtcgagctgggaaggttccatgaagcgagtcgggtccccaacccgtgcccctgggatccgagggcccctctccaagcgcctggctttggaatgctccaggcgcgccgacgcctgtgccaccccttcctcagcctggggtttgaccacccacctgaccaggggccctacctggggaaagcctgaagggcctcccagcccccaaccccaagaccaagcttagtcctgggagaggacagggacttcgcagaggcaagcgaccgaggccctcccaaagaggcccgccctgcccgggctcccacaccgtcaggtactcctgccagggaactggcctgctgcgccccaggccccgcccgtctctgctctgctcagctgcgcccccttctttgcagctgccagcccctcctccctgccctcgggtctccccacctgcactccatccagctacaggagagatagaagcctctcgtcccgtccctccctttcctccgcctgtccacagccccttaagggaaaggtaggaagagaggtccagccccccaggctgcccagagctgctggtctcatttgggggcgttcgggaggtttggggggcatcaaccccccgactgtgctgctcgcgaaggtcccacagccctgagatgggccggcccccttcctggcccctcatggcgggactggagaaatggtccgctttcctggagccaatggcccggcccctcctgactcatccgcctggcccgggaatgaatggggaggccgctgaacccacccggcccatatccctggttgcctcatggccagcgccc

SEQ ID NO: 327397 - DNA, 427 bp, Homo sapiens
gaaaggaagatcatagactcttgttttaatgaacttgatcaccatcagctacattagagcgaaaaatttaaaatttaaaactctactaatatattctgagggttcattcttggcttgtctttgaaagaaattgaactaaagcaactatatgactgtattgtattatgttggagtctttatatttcacctttaccccttctttcctcttcaaagcaactaattttagcagttcatagacatccagatagtacttctttaaaagaaaagggccaggcgtggtggcttacgcttgtaatcccagcactttgggagactgaggccagtggatcacctgaggagttcaagaccagcctggtccaacatggtgaaaccccccctctactaaaaatacaaaaattagccgggcatggtggccggtgcctgtaat

SEQ ID NO: 327398 - DNA, 240 bp, Homo sapiens
tctcagcaaaaaagtaaggcctccgccgcacaaaaaataagaaagacagagaaaccaccttccaagcgactttgcggcagaagcgttggggccgctccgtataggttccacgcacagggccaaccgccctcggggacttactaacaaaatgagccacttgcattcaatgatctcaactgctccgtgctacatccaattcagtaaagcacagttttttcatttttcacattcagattgaag

SEQ ID NO: 327399 - DNA, 447 bp, Homo sapiens
tatagagatgcatccccaaccccatctacaaaagcgagaacgatgccagaaacaatactatgcactgaaatctctcagtgatctaaataactcaggtccaaagaccaagaacattcttcatgctgcattaaagtgacattgctcttggtattattaaaacacttataagtggccatgctgaaacccaattctctgtaccactgaaaactcaataccataaatcccaatggttttatctggactttaaaaaataaacttgaggtgcctatctaccaactcccgaaacagcattccagactattaagcactgccctctgctttattttttaaaaatgcattattcaaattcaaataaaagaaacaagaacttgagttcctccttaggagtaaaggctaggcaagctatttccatctagaggtgactaccatgacatcttggtttatgtg

SEQ ID NO: 327400 - DNA, 364 bp, Homo sapiens
tcatcaaagacactgttaaagccacattctaagggaaaatatggtcaagaactcatgtctagaacatgtaagaacttcaacagcttacatattttttaaaatctaatttacaagtagataaagatttgaatagaaacttcacaaaaagatacataagcagctaatgagcacatgaaagagtgtttaacatcctccaacctcagcctcccaggttcaagcgattctcctgcctcagcctcccaagtagctgggagtacaggcagctaccaccaggcccggctaattttggtatttttagttgagacagggtttcaccatgttggccaggctggtctcgaaatcttgacgtcagttgattcaccca

SEQ ID NO: 327401 - DNA, 507 bp, Homo sapiens
atgctttattttatgcttaaaataaaacatatcacatagtagcattgtaacttttattttaataatgatgatgtgagattgggtttatttccacaaatatcctgatattttcattcacctaaaaaattccaaaacatttcagttttagataaagcaatgttataagttttcatcacccagcaggtctatgtattatgaatacattgagcaatgacccaaccctcagctttgttggaatggcacttgtctcatgagtaggcattattttgaattttcccgaaaattttatttgcatgtcccttttaattttttttcttttttctttttcctgttttttgagatggagtctctctctgtcacccaggctggagtgcaatggtgtgatctcagctcactgcaacctctgcctcccgaatctcctgcctcagctggattacagcatagatgctggctcctagggtgggcagattctggtcctgcaccaaccctgactggtgaccttcttgt

SEQ ID NO: 327402 - DNA, 4216 bp, Homo sapiens
  misc_feature (4213)..(4216): n is a, c, g, or t
atgtgtatatatatatatgcaaatgtttgcagtatatttcaaaaattgaaacgattttatgtctcccaggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcaggctagaatagcattttccaaagaatattctaagagctattagctcctctagatatttttttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagatacactgtcagaaacttgagatcttttggcctatgataataccattaatttttgcattgcttcagtttgccaagtgtttttacatcatctcatttgatctcaaaacagcttgacagagcaactgttattgaaatattacagatggaaagaatgaggctcagggaagttaaatgacttggccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattaggaatataaaaacttgcagttctatgatagattgcatttattaaaaatgtttcattgtatcacatagaaatatggccaggaaggacttgagaagacagtttgatccattgcttttagacaggactgggttttgctgtccaattatatacaataatagtttttcttacaactaagctggccccagccttgtcttgatattaatacatgaaatttttataattgtctcattgtctcatttagaaacatccatatttttctgctttttctattgccattttttatttgtgcatgaattgattattgagaaaatgtagcagtttgcatatttaaaaattaatcattttgcattttacatttaaatatgctaacatcactgtcatagaattcccaaatttcatttgtagatactgaactaagggctaatgtcaggagctgatttttaatgataaagctgcagatgggctaaataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttcaaatgtctggccatttagcaaagttatttactatttactgtgtacatagaaagctttattatgtgtggtgtatctaaattttttttgctgaaatacattatggtcaatcaagccaagcctgcatgtacagaatttgtttttttttcaaataaattagttgttttcttatttttttggcttagtatgttgaaataaactatggtatcttcatcattttgtacatttcctttttgaggaaggtttctttataagtgcaagggctaccctaataaaggaatgtatatacttacaaaaaannnn

SEQ ID NO: 327403 - DNA, 4887 bp, Homo sapiens
  misc_feature (4884)..(4887): n is a, c, g, or t
ggctggccgaagttaggcggagccccgaggcgggggaggcggggccgggccggcgcagggagagtcactcaatggacaggcgagaaagcaggaccggcgcggcggggcggggccggccgagtccctagagctgggggcggggcggacccagcggaccagcggaccacctgggtgctgtcgtagttggaggtggcctgaggagctcagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcaggctagaatagcattttccaaagaatattctaagagctattagctcctctagatatttttttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatatcttttggcctatgataataccattaatttttgcattgcttcagtttgccaagtgtttttacatcatctcatttgatctcaaaacagcttgacagagcaactgttattgaaatattacagatggaaagaatgaggctcagggaagttaaatgacttggccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattaggaatataaaaacttgcagttctatgatagattgcatttattaaaaatgtttcattgtatcacatagaaatatggccaggaaggacttgagaagacagtttgatccattgcttttagacaggactgggttttgctgtccaattatatacaataatagtttttcttacaactaagctggccccagccttgtcttgatattaatacatgaaatttttataattgtctcattgtctcatttagaaacatccatatttttctgctttttctattgccattttttatttgtgcatgaattgattattgagaaaatgtagcagtttgcatatttaaaaattaatcattttgcattttacatttaaatatgctaacatcactgtcatagaattcccaaatttcatttgtagatactgaactaagggctaatgtcaggagctgatttttaatgataaagctgcagatgggctaaataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttcaaatgtctggccatttagcaaagttatttactatttactgtgtacatagaaagctttattatgtgtggtgtatctaaattttttttgctgaaatacattatggtcaatcaagccaagcctgcatgtacagaatttgtttttttttcaaataaattagttgttttcttatttttttggcttagtatgttgaaataaactatggtatcttcatcattttgtacatttcctttttgaggaaggtttctttataagtgcaagggctaccctaataaaggaatgtatatacttacaaaaaannnn

SEQ ID NO: 327404 - DNA, 4941 bp, Homo sapiens
  misc_feature (4938)..(4941): n is a, c, g, or t
ggctggccgaagttaggcggagccccgaggcgggggaggcggggccgggccggcgcagggagagtcactcaatggacaggcgagaaagcaggaccggcgcggcggggcggggccggccgagtccctagagctgggggcggggcggacccagcggaccagcggaccacctgggtgctgtcgtagttggaggtggcctgaggagctcagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcaggctagaatagcattttccaaagaatattctaagagctattagctcctctagatatttttttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagatacactgtcagaaacttgagatcttttggcctatgataataccattaatttttgcattgcttcagtttgccaagtgtttttacatcatctcatttgatctcaaaacagcttgacagagcaactgttattgaaatattacagatggaaagaatgaggctcagggaagttaaatgacttggccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattaggaatataaaaacttgcagttctatgatagattgcatttattaaaaatgtttcattgtatcacatagaaatatggccaggaaggacttgagaagacagtttgatccattgcttttagacaggactgggttttgctgtccaattatatacaataatagtttttcttacaactaagctggccccagccttgtcttgatattaatacatgaaatttttataattgtctcattgtctcatttagaaacatccatatttttctgctttttctattgccattttttatttgtgcatgaattgattattgagaaaatgtagcagtttgcatatttaaaaattaatcattttgcattttacatttaaatatgctaacatcactgtcatagaattcccaaatttcatttgtagatactgaactaagggctaatgtcaggagctgatttttaatgataaagctgcagatgggctaaataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttcaaatgtctggccatttagcaaagttatttactatttactgtgtacatagaaagctttattatgtgtggtgtatctaaattttttttgctgaaatacattatggtcaatcaagccaagcctgcatgtacagaatttgtttttttttcaaataaattagttgttttcttatttttttggcttagtatgttgaaataaactatggtatcttcatcattttgtacatttcctttttgaggaaggtttctttataagtgcaagggctaccctaataaaggaatgtatatacttacaaaaaannnn

SEQ ID NO: 327405 - DNA, 4851 bp, Homo sapiens
ggctggccgaagttaggcggagccccgaggcgggggaggcggggccgggccggcgcagggagagtcactcaatggacaggcgagaaagcaggaccggcgcggcggggcggggccggccgagtccctagagctgggggcggggcggacccagcggaccagcggaccacctgggtgctgtcgtagttggaggtggcctgaggagctcagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcaggctagaatagcattttccaaagaatattctaagagctattagctcctctagatatttttttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagatacactgtcagaaacttgagatcttttggcctatgataataccattaatttttgcattgcttcagtttgccaagtgtttttacatcatctcatttgatctcaaaacagcttgacagagcaactgttattgaaatattacagatggaaagaatgaggctcagggaagttaaatgacttggccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattaggaatataaaaacttgcagttctatgatagattgcatttattaaaaatgtttcattgtatcacatagaaatatggccaggaaggacttgagaagacagtttgatccattgcttttagacaggactgggttttgctgtccaattatatacaataatagtttttcttacaactaagctggccccagccttgtcttgatattaatacatgaaatttttataattgtctcattgtctcatttagaaacatccatatttttctgctttttctattgccattttttatttgtgcatgaattgattattgagaaaatgtagcagtttgcatatttaaaaattaatcattttgcattttacatttaaatatgctaacatcactgtcatagaattcccaaatttcatttgtagatactgaactaagggctaatgtcaggagctgatttttaatgataaagctgcagatgggctaaataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttcaaatgtctggccatttagcaaagttatttactatttactgtgtacatagaaagctttattatgtgtggtgtatctaaattttttttgctgaaatacattatggtcaatcaagccaagcctgcatgtacagaatttgtttttttttcaaataaattagttgttttcttatttttttggcttagtatgttgaaataaactatggtatcttca

SEQ ID NO: 327406 - DNA, 1918 bp, Homo sapiens
ggctggccgaagttaggcggagccccgaggcgggggaggcggggccgggccggcgcagggagagtcactcaatggacaggcgagaaagcaggaccggcgcggcggggcggggccggccgagtccctagagctgggggcggggcggacccagcggaccagcggaccacctgggtgctgtcgtagttggaggtggcctgaggagctcagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaaaaaaacaaaacctccaacaccaacaaaaacaataacccacattcccctgggaatctctacctacccaataaaattgcggcccgaattggggctcacttggcccattcg

SEQ ID NO: 327407 - DNA, 1435 bp, Homo sapiens
agcatcacacattgctgcatcagagaggtcttaagacaggaagctagagtcttggtgcatgctcgaagtgagacggtgtcagcacagagcagggtaaagtcttcccgttaactcttcaccagagctatgactggaatcagaggttgaaaagatgtgagactgtacccaagaagcatcttataagcctacgtaatatactgttagactcatcgaaatctatttcctcccttctttataatcaaaacttcagtgtccagaataaagttggcagaagggttaaattggaaagttaaatgtactagaaggtgtacatttataagttttgaccttgagtcgtgttcaaggagaaagtgacattggaacttggaaaatttaaaaatgattctacttgaaaaatttgaccattgcatagaaatattagctatcgtctaatcttttgtaatcttagaaacaatcgtgaattgtttggtgaaaaatgaaaaaataaccatttcttatgtctccgtgacctttatagaccaatgtcaccaacttttcctaaggtaattgtttcctactgtcaaatagctctagtgatataaatcttaacaatcaatgaagggaaaactggtggaaacataggaggaaaaatactgggataattttcatcacaaagtattggcattaacattggttagaataggggagaaactgcatgacttgacaactggacattcctgtatgttgtatgaggccctgtcttaacagaaatagtgatgtcatcatcatcctctcttatttggtcttgaattgccaccaatcggataaaacctttgaattatttaactcaaaaaaaaaaaaaaaaaaaaaaaaaaaaagtgtgtggtgggggcgccgcggggccccgggaaaagatttctctaagaacacaaacgagaggggggccgcgggccccacataaggtaaagtggaacaaggtggcacaaagcggtgagtcccaagagggaacaccgggggacatggacaaaggggcggggagaatctcctaacgaacaatataaaaaaaagcgcgcgcggggggggcgaaacaaggggaggcgtgctctcggagagaacacaaatccacacagaagagggagagagacacaagagcgcgagcacataacagcggggggagccactatatatacacaaaagcgggagagtactccacaagggaggagaaaaccctgcgcacagaattcatcaacaaaaattatcgacagcccacggcacgggatggaggggggggggtgatgaaacaagaacgcagacgacgccagaacgactacgacacacagagactgcaaaagcaacatccaagaccaacacaaaccaaaccgcgaacagacaatccacagcacaaaatacacaaccacaacacaacaacagcgacacccacgcgaaagaatacaac

SEQ ID NO: 327408 - DNA, 2360 bp, Homo sapiens
agcatcacacattgctgcatcagagaggtcttaagacaggaagctagagtcttggtgcatgctcgaagtgagacggtgtcagcacagagcagggtaaagtcttcccgttaactcttcaccagagctatgactggaatcagaggttgaaaagatgtgagactgtacccaagaagcatcttataagcctacgtaatatactgttagactcatcgaaatctatttcctcccttctttataatcaaaacttcagtgtccagaataaagttggcagaagggttaaattggaaagttaaatgtactagaaggtgtacatttataagttttgaccttgagtcgtgttcaaggagaaagtgacattggaacttggaaaatttaaaaatgattctacttgaaaaatttgaccattgcatagaaatattagctatcgtctaatcttttgtaatcttagaaacaatcgtgaattgtttggtgaaaaatgaaaaaataaccatttcttatgtctccgtgacctttatagaccaatgtcaccaacttttcctaaggtaattgtttcctactgtcaaatagctctagtgatataaatcttaacaatcaatgaagggaaaactggtggaaacataggaggaaaaatactgggataattttcatcacaaagtattggcattaacattggttagaataggggagaaactgcatgacttgacaactggacattcctgtatgttgtatgaggccctgtcttaacagaaatagtgatgtcatcatcatcctctcttatttggtcttgaattgccaccaatcggataaaacctttgaattatttaactcaatatatgttaagtttctactatgtgctgtgtattggtactataaatatgaataagacataagatattacattcaaaaacatcagaatacatgttcttttaaagtataccccaaaacatttaccatgtgttctggggcgcatgttaggctggatcacaaatcaagtctcaagaaatttcaaaagattgaaatcatatagagtatgaattaaaccagaaatcaagtacataaaggtaacaaaaaatttccaaaatgcattaatttaaggaacatacacctcatgacccatgagccaaaaaataaatcacggcaaaattgcaaaaatattttgaaatgaattttaaagaaaatacttagcatattaaatacttagcatattaaagctctaagtacatatgttagaaattttaccgaaaggttggctatcagtgtttccagaagccagggaaaaagtttatacaatttgatcgctgaggcagggaaacaaagtgagacctccgatcgccctgcctttctgaggtgagcactctggatcccatcgcaggagatcagagtcttgctgagttgaggagaggaagattggagttgatactgagatagcttgaattttcaggacaaagtatcaacaaggaggaaggtagacaaaaaaatccagaaatctatgtagagaccccattgtgtacattgcggaacactaagcctaacaattctcaaaattagcgtgagattgggaaatatctaatttccatccagccacagtggagagtcctgactgaaaaccaggcattcgctaaagatcccagaaaggttgtgtgttacatacgtagggctaaactatcctgactaaaaactacactacacttgctcctcacccccacaaaaagcttaaaaacaagcctcaatagtataaagctgatctgtaagtaactaaactacctgcagaacaaagtccaaatttattagttccagtactccaaaaaaaacacatgtaaaaaaaaaatagatttacaagacatttatttggggaaaaaaagaatgcctgagggttgaaatggagaggaagccagagagacagagtcctcagaatacataaaatttctggcctccatggaggtgtgatggttaattttatgcatgtcaacttcgctgggccacaggatgccccatatatgatcgaacattatttctggttgtgttcatgaagctttttctggaggaaattcgcatttgaattgatggactgaataaagcagattgcagtccccagtgtggatgggcttgatccagtcttctaaggacccaaataaaataggtggaggaagcttgaattttctgcctgactgtggcgctgggacacccatcttctcctgcccttgaactgggactgacaccatcagtgctcctggttctcagacttcggacagcagacttggggccttctcggcctccattattgtgtaagccaattccttataataaataagggtttatttattgataaatccttataggttgattataaaaaaaaaaaa

SEQ ID NO: 327409 - DNA, 249 bp, Homo sapiens
gagttcacagtttaccatatgctgtattaggagttagcatacttttcctgtaaaggaccaggtggtaaatattttaggctttgtaggccacatgtgatctctgttgcaactactcaactcttttcttatagcacaaaagcaacaatagacaatacataaaattttatttagggacattgaaattaaattttatatgatttttatgtgtcacaaagtattgctctgtttaaaatttgttttcaacaatta

SEQ ID NO: 327410 - DNA, 391 bp, Homo sapiens
ggaaagaaatggacgtgctgcagagaaaggcagaagcaagagttaataacaaaattaagcaattcaagcttcccaagctcttgctgtttttgaagttaatatggattagaggctatatcagggcaaagaaagcagcagtttagcagtggagagatctgaggctcattctcaataactatgagaacctgggcaagacccttcaccactccagatgccacacttgcttcagaatctataacgtgagatgaagagagacggtccccactgtgccccttccatagtgaggggatgacatagtgagggaggctcagacctttgagataagattaccctctgaaagcaaatgtggtcaagcacagtgcccgagaagagatcaactctctgtaaaatc

SEQ ID NO: 327411 - DNA, 2301 bp, Homo sapiens
tcaggctagtacgaggctgggttaatcggccgagggaattgaaaaaggatcccaaaggagtcgattcttaaaaactctgcttctgttggtattatccaaagagatgagtcacccatggaaaaagggctctctggtctacgaggaagggactttgagctgtctgacgtgttttatttctccaagaagggattggaagccattgtagaagatgaagtgacccagaggttttcctcagaggagctagtgtcatggaatctcctcacaagaaccaatgtaaatttccagtacatcagtctgcggctcactatggtgtgggtgctgggcgtcatagtgcgctattgtgtcctactgcctctgagggttaccttggctttcattgggatcagtttgctggttataggaactacactggttgggcagctgccagacagcagcctcaaaaactggctgagtgaactggtccatctgacttgctgccggatctgtgtgcgagccctctctggtaccattcattatcataacaagcagtacagaccccagaagggaggcatttgtgttgccaaccatacttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagagactaaaagaacatattgctgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttcgaatgatgaccagctgggccatcgtctgtgacgtgtggtacatgccccccatgaccagagaggaaggagaagatgcagtccagtttgctaacagggttaagtctgctattgctatacaaggaggcctgactgaacttccctgggatggaggactaaagagagcaaaggtgaaggacatctttaaggaagagcagcagaaaaattacagcaagatgattgtgggcaatggatctctcagctaagaggacggatgacagcctttagatctagaactagcccttagaaatggaatggcttttttgttttgttttgttttattgttttgtttttattattgttaatcttttctacagaatgattgtctctacctctttatgccagaggcagaacctacaggtgccctttttggcttttgttgttgttgtaacattagccccatggattgtaaggtggtttactgagttaaaacagattctgcttttgtaaaatgatggcatcactgtggactgaatgaaatatttgtatagaaaaaagtgcttgaaaagtgtgtttggaactcatcgatagggtaattctccaaaaatgcccaaactctctttctgtaattagccttgccactttcttcagtcacttaaatggtgagattacacatcagtgcaagatgaccattatggttatggtctactgcaaggttgaaaggaaaaatggaggattgtatttaggaaaagggacaactttgtggccacctgctctgaaagtcaaaaggaaatgtaaattagtgtcattagtgtgttggaagagaaatactattcagtaagcttcgccaaagaaaagtgagtcaaagttaatgtgtgtgcgcatttatatgtaggcagctcgtagaccacattttagccagcaactggtaacaaagagcttagttttccttgtttgaatgctgtagatctgtacctagtacccctcccatctactgatttgtttgtttttgtaaccaaacacattttcagatagaaggagccttaaaaaaaaaaaaatcacattgagtaacttcagtatgaatgaatgagagtgtgtggagctacccctcaccctccacccctttgtgctttttattcccgaattttcccagtctcttaaacagaaaaatgactgatataattatcttttggaaactgagccttaattttttttagagggggaaataagttttccccaactcacacagcataagcaatgtttgacagcaatataatgccgttgtaaactactgagagtattgtatctgttctggtaaccatgtacagaatgtgaaactgtcttatgaatataaataaattctatatttctaaaaaaaaaaa

SEQ ID NO: 327412 - DNA, 1149 bp, Homo sapiens
aatggaatggctagttctagatctaaaggctgtcatccgtcctcttagctgagagatctagaactagcccttagaaatggaatggcttttttgttttgttttgttttattgttttgtttttattattgttaatcttttctacagaatgattgtctctacctctttatgccagaggcagaacctacaggtgccctttttggcttttgttgttgttgtaacattagccccatggattgtaaggtggtttactgagttaaaacagattctgcttttgtaaaatgatggcatcactgtggactgaatgaaatatttgtatagaaaaaagtgcttgaaaagtgtgtttggaactcatcgatagggtaattctccaaaaatgcccaaactctctttctgtaattagccttgccactttcttcagtcacttaaatggtgagattacacatcagtgcaagatgaccattatggttatggtctactgcaaggttgaaaggaaaaatggaggattgtatttaggaaaagggacaactttgtggccacctgctctgaaagtcaaaaggaaatgtaaattagtgtcattagtgtgttggaagagaaatactattcagtaagcttcgccaaagaaaagtgagtcaaagttaatgtgtgtgcgcatttatatgtaggcagctcgtagaccacattttagccagcaactggtaacaaagagcttagttttccttgtttgaatgctgtagatctgtacctagtacccctcccatctactgatttgtttgtttttgtaaccaaacacattttcagatagaaggagccttaaaaaaaaaaaaatcacattgagtaacttcagtatgaatgaatgagagtgtgtggagctacccctcaccctccacccctttgtgctttttattcccgaattttcccagtctcttaaacagaaaaatgactgatataattatcttttggaaactgagccttaattttttttagagggggaaataagttttccccaactcacacagcataagcaatgtttgacagcaatataatgccgttgtaaactactgagagtattgtatctgttctggtaaccatgtacagaatgtgaaactgtcttatgaatataaataaattctatatttctaaaaaaaaaaa

SEQ ID NO: 327413 - DNA, 812 bp, Homo sapiens
agctatggtcaaggctgtcctcatgtctggtttgaacgctcagaaatgaaggatcgacacctggttactaagaggtaaccaggtgtcgatccctcatgtctggtttgaacgctcagaaatgaaggatcgacacctggttactaagaggtaagcagtgaaattactcagcattcactggagtagcataaaagctgaccaatcttggccttgctaccaaagagggccgagcagcactgagtctcaaaactgaaacagagccctgtttgctgttggatttttctggcaaatcacctgtcttagccagatttttaaaaaatgtaattctgtagtcatggtaggatatatgatgggattggaaggccaatgtatttatattgctgtgacttagatatagtccagtcactgaattttcaaagataaaaattaccacctttaaattagatatgatctcacttgagtataagcaattaaaaaaataaattagatatgtatactttacctcaataaaaaatatataaaaaagaaaaaaaaaccaccttgaaggttaaatatttgataactacttgctaaatatatgattgattaagtgtttgctgaatgattgttatcacttaaatccagctagaagctgggcatggtggctgacgtctgtaatcctagcactttgggaggccaaggtaggagaatggcttgaacccaggagttcaagaccagcctgggcagtatagtgagacctcatctctacaaaaaataaataaaattagccaaatgtggtggcatatgcctgtggtcccagctacttgggaggaagg

SEQ ID NO: 327414 - DNA, 1399 bp, Homo sapiens
tcaggctagtacgaggctgggttaatcggccgagggaattgaaaaaggatcccaaaggagtcgattcttaaaaactctgcttctgttggtattatccaaagagatgagtcacccatggaaaaagggctctctggtctacgaggaagggactttgagctgtctgacgtgttttatttctccaagaagggattggaagccattgtagaagatgaagtgacccagaggttttcctcagaggagctagtgtcatggaatctcctcacaagaaccaatgtaaatttccagtacatcagtctgcggctcactatggtgtgggtgctgggcgtcatagtgcgctattgtgtcctactgcctctgagggttaccttggctttcattgggatcagtttgctggttataggaactacactggttgggcagctgccagacagcagcctcaaaaactggctgagtgaactggtccatctgacttgctgccggatctgtgtgcgagccctctctggtaccattcattatcataacaagcagtacagaccccagaagggaggcatttgtgttgccaaccatacttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagaggtaagcagtgaaattactcagcattcactggagtagcataaaagctgaccaatcttggccttgctaccaaagagggccgagcagcactgagtctcaaaactgaaacagagccctgtttgctgttggatttttctggcaaatcacctgtcttagccagatttttaaaaaatgtaattctgtagtcatggtaggatatatgatgggattggaaggccaatgtatttatattgctgtgacttagatatagtccagtcactgaattttcaaagataaaaattaccacctttaaattagatatgatctcacttgagtataagcaattaaaaaaataaattagatatgtatactttacctcaataaaaaatatataaaaaagaaaaaaaaaccaccttgaaggttaaatatttgataactacttgctaaatatatgattgattaagtgtttgctgaatgattgttatcacttaaatccagctagaagctgggcatggtggctgacgtctgtaatcctagcactttgggaggccaaggtaggagaatggcttgaacccaggagttcaagaccagcctgggcagtatagtgagacctcatctctacaaaaaataaataaaattagccaaatgtggtggcatatgcctgtggtcccagctacttgggaggaagg

SEQ ID NO: 327415 - DNA, 366 bp, Homo sapiens
gcctctgagcagaagctaagccatcataacccctgtgacctgcatgtatacatccagacggcctggagcaatggaagaacaacaaaagatgacattccatcatttgatttgttcctgccccaccccaactaatcaatcgaccttgtgacattcctcccctggacaatgagtcccatgatctccccaccctgcaccttgtgacccctgcccctgcccgcaagagataaccaactttaactgtaattttccattacctacccaaatcctataaaactgccccactcctatctccctttgctgaatcctttctccgactcagcccacttgcacccaagtgaataaacagccttgttgctcacacgaagc

SEQ ID NO: 327416 - DNA, 1562 bp, Homo sapiens
cggacacggggcggagggcggggcgccgggtccggagggagccacgcccaccacaacaacgcgtctgcgcatgcccgggcgctgggttcaggggctttccgccgctctgggttcacagctggacgtcgggagtgctagtttggagtacgccatttgagagtaggcgtgagaagttgctctgtgtgctgagcgttctaaaggaaggcgtccgttggccttcgtacccgtcttgattgaggtgacgagtgttttctagtactggggtcggccgcgcagccctctcaggggtgggtggcaggaagagtgccgggtcccgcgtggtgcaaaaggtgggttcaggtttgcggccacacagcgctactcaggactttttagtcttgtttattttctccgtgcctgttcccgccccccgcagctccacctctgggagaggggcgggttcagctccaggaggcggggacttcccggcttggcgtggctggggtgtcccgtggaccccagtctcggcgcggtgacccacttatgggacttggcctttctttgttgtttgtttaaggcagggtttctcagcctgggcactactgaggttttgggccggctaattctgtctgggttggggagggtgctgtcccgtgcttcgcaggttgtgtagctgcatcccccgcctctacccagtggatgcaagtagcagccccagtgaaccaaaaatgcccccagactttgccaaatatcccctcccggggaagatcgcctcgcttgagaaccactgttggaggagagcctgggttttcgggaggtaaccgtttacaaaggggagaacggtaagaagccggaagcaacgatgacttagctacgtgaaagacttgcggccgggctcgcccctcttctagaagccgtcagtttgggtctcgcgtctggaatcaccgtcaaggagtcagatccagccccggagagggagcagggtcgaggtctccttgcagaaggcgccaccgcaggaagcacaggcgcaacgtgcagtctccctagcggaggcgctcgcgatcctgcagccgccggtccgggaggtgctcggtagccctccttggtgcctgtccggtagctggtcactctcgggggaaggtcgtgtgcagaagggcacatgcgatcacacagagacggcgttgctgcggctttgacccgatggtgcacccgaaagaacacagagggtggagggggagatccaggaagtggtcgcggagcagaaccccctttcacttcagtcaaaaatgtgggtcaattgtcattaagagatacgcacaggttcatctgattgacatgtacggcggcagtatatgagtgagatgggaaccaaggtgactgttgtttcctttgatggatgaaactttcatccctttggggttttttgtttttggcgggatattagccgattagtagataaaactgcatgatacaatctatagcctgtttttaaatggacaagttcttaccactcaggaggtttatcgtgattgtttaatgtctcagggtggaggaatctagtgcaggcagttcttaatgaaacc

SEQ ID NO: 327417 - DNA, 809 bp, Homo sapiens
cggacacggggcggagggcggggcgccgggtccggagggagccacgcccaccacaacaacgcgtctgcgcatgcccgggcgctgggttcaggggctttccgccgctctgggttcacagctggacgtcgggagtgctagtttggagtacgccatttgagagtaggcgtgagaagttgctctgtgtgctgagcgttctaaaggaaggcgtccgttggccttcgtacccgtcttgattgagctctcacactttggatacgctcctctaatcctgtctgaaagagctaagctgacccccaccaccgttggaggaaactcctggagcagtgctggggttttcactgcaatcagctgctccaactttgtcttgtacatggctctttgaccttgggcttgtggattaggggcctgtggaggagctctgtgactgctctgatatctgtggatggttctgaggcattgtatttagtgaaaaaactggaaaccatatgcatgtccatgaataaaaaatggggcataggccgggcgccgtggctcacacctgtaatcccagcactttgggaggcgaggtgggcggatcacctgaggtcgggagttcgagaccagcctgaccaacatggagaaaccccatctctactaaaaatacaaaattagctggacgtggtcgcgcatgtcagtaatcccagctactcgggaggctgagtcaggaaaatcgcttgaacccgggaggcggaggttgcagtgagccgagaccgtgcagcctgggcaataagagcgaaactccatctcaaaaacaaacaaacaaaaaaaca

SEQ ID NO: 327418 - DNA, 721 bp, Homo sapiens
cggacacggggcggagggcggggcgccgggtccggagggagccacgcccaccacaacaacgcgtctgcgcatgcccgggcgctgggttcaggggctttccgccgctctgggttcacagctggacgtcgggagtgctagtttggagtacgccatttgagagtaggcgtgagaagttgctctgtgtgctgagcgttctaaaggaaggcgtccgttggccttcgtacccgtcttgattgagctctcacactttggatacgctcctctaatcctgtctgaaagagctaagctgacccccaccaccgttggaggaaactcctggagcagtgctggggttttcactgcaatcagctgctccaactttgtcttgtacatggctctttgaccttgggcttgtggattaggggcctgtggaggagctctgtgactgctctgatatctgtggatggttctgaggcattgtatttagtgaaaaaactggaaaccccttcttgtggagtaaaagttaaatattaaatttgaactcaattggacttgaacacaaggaatggttacctgccagaaatctgtccctgggcacttgctcaggaaccggatggacatactgattggtcttgataaatcatcatctgcctcgaggcaataaacaaaaccttgaaaataggctgacctttccgtgttccttgagtccaatgacaaaaggcccttgtgcctaggcctcatg

SEQ ID NO: 327419 - DNA, 796 bp, Homo sapiens
cggacacggggcggagggcggggcgccgggtccggagggagccacgcccaccacaacaacgcgtctgcgcatgcccgggcgctgggttcaggggctttccgccgctctgggttcacagctggacgtcgggagtgctagtttggagtacgccatttgagagtaggcgtgagaagttgctctgtgtgctgagcgttctaaaggaaggcgtccgttggccttcgtacccgtcttgattgaggtgacgagtgttttctagtactggggtcggccgcgcagccctctcaggggtgggtggcaggaagagtgccgggtcccgcgtggtgcaaaaggtgggttcaggtttgcggccacacagcgctactcaggactttttagtcttgtttattttctccgtgcctgttcccgccccccgcagctccacctctgggagaggggcgggttcagctccaggaggcggggacttcccggcttggcgtggctggggtgtcccgtggaccccagtctcggcgcggtgacccacttatgggacttggcctttctttgttgtttgtttaaggcagggtttctcagcctgggcactactgaggcgggcggatcacctgaggtcagcagttagagaccagcctgaccaacatgaagaaaccctgtctctactaaaaatacaaaattagccaggcatggtggtgcatgcctgtaatcccagctactcgggaggctgaggcaggagaatcgcttgaacccgggaggtggaggttgcggtgagctgagattgcgccattgcactccagcctgggca

SEQ ID NO: 327420 - DNA, 501 bp, Homo sapiens
cctttttcctctttgtagctctcacactttggatacgctcctctaatcctgtctgaaagagctaagctgacccccaccaccgttggaggaaactcctggagcagtgctggggttttcactgcaatcagctgctccaactttgtcttgtacatggctctttgaccttgggcttgtggattaggggcctgtggaggagctctgtgactgctctgatatctgtggatggttctgaggcattgtatttagtgaaaaaactggaaaccccttcttgtggagtaaaagttaaatattaaatttgaactcaattggacttgaacacaaggaatggttacctgccagaaatctgtccctgggcacttgctcaggaaccggatggacatactgattggtcttgataaatcatcatctgcctcgaggcaataaacaaaaccttgaaaataggctgacctttccgtgttccttgagtccaatgacaaaaggcccttgtgcctaggcctcatg

SEQ ID NO: 327421 - DNA, 490 bp, Homo sapiens
cggacacggggcggagggcggggcgccgggtccggagggagccacgcccaccacaacaacgcgtctgcgcatgcccgggcgctgggttcaggggctttccgccgctctgggttcacagctggacgtcgggagtgctagtttggagtacgccatttgagagtaggcgtgagaagttgctctgtgtgctgagcgttctaaaggaaggcgtccgttggccttcgtacccgtcttgattgaggtgctggagaatcggtaaaagcaccattgtgaagcacatgaggatcctgcatgttaatgggtttaatggagatgagaacgcctccaaagtgcaggacatcaaaaacaacctgaaagaggcgattgaaaccattgtggccgccatgagcaacctcttgccccccgtggagctggccaaccccgagaaccagttcagagaggactaccttctgagtgtgatgaacgtgcctgactatgacttccctcccgaatt

SEQ ID NO: 327422 - DNA, 94 bp, Homo sapiens
gctgctaggatgttgctgttgtgtgagaatatgaagggggatgagaaaaaaacaatggaatggaatgaattcaagaccaaataaagtccgtggt

SEQ ID NO: 327423 - DNA, 522 bp, Homo sapiens
ctagacttcagggctgcacctgtcaggcctgggagcataccatcgactgagcaaggagttgttcaagaaatcagcctataccagactgtgtgtgatattccttgaccacagagacaagatttagaacatgcacacgattcagtctggaacaagatgcaagatgcgacggtttcttgcaaagttatggggatgaagtttaactgctctggacagaaagctgctaggagataatctttctttgctcgtcatgacataaggatgacccctgggattgcttcaaccattttgccaccaatatggaactcttctgctaaagaactaagtccgtacggagaagagcggaaccaaaggggttagagagaaacaggtggaaatgccggcttgagcctgccccaagtcccttcctgtctctggactccaggtacaggggccaataagctgagtgatattaagagtatgaaacaacttgtatagtatgttatatatgtacatataagccaatatataataaactactcatat

SEQ ID NO: 327424 - DNA, 125 bp, Homo sapiens
ctcacttctgtaacttccttcccacctcacgtagttctcgctttttagatgtttaaaagtaggagggccgggtacggtggctcatgtctgtaatcccagcactttgggaggctgaggcaggtgga

SEQ ID NO: 327425 - DNA, 321 bp, Homo sapiens
tattgctacattgtaagaagagcaaactttcatcttgttaataagtaacacggaaattttttattaaaaaacttttttaaaaaactgtgaggaaattcatttattcgctatacaccatatctttttatgtgattatgccttgtaaaagaggtatcattgtgataagaatgtttaaaagttgtagtttgctaaattaagtgctcctctatttgtttttgaatgtgttatttttaaacagttttatggtaacggattttgatctagagtcgtgtttctgcattatgcatttgtggtttctggctacattgggggcgtgggggg

SEQ ID NO: 327426 - DNA, 217 bp, Homo sapiens
atcacacatacacacaaacacacccccacaaccacacatgcacacatcattgtgcacactcatacaggcacatttcctcttttctcaggttgcatatcccacctaccccctcccgcagtggactggccactagaaaggaccctgcagtttggtctgagaaacagtggttggagcttctggagacatggtctctcaaactctacttgccttgcttatt

SEQ ID NO: 327427 - DNA, 127 bp, Homo sapiens
cgccgccgccgcgagtccagctcgcaggaggaggaggtcatcgacggcttcgccatcgccagcttcagcaccctggaggccctggagaaggatatggccctgaagccacatgagcggaaggagaagt

SEQ ID NO: 327428 - DNA, 1873 bp, Homo sapiens
cccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcccaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctca

SEQ ID NO: 327429 - DNA, 1677 bp, Homo sapiens
cccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcccaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtgagtgtgcacctgtacttgtggaagtgtactcttggggatatggggcttctgcagatgtggaaactccagccacctgaggaaatgttcagtctctcaattcctggtcatctgatttgttcctgtctgatggacacagtgaactacatgattgcttgtatttccattttgcttgggctgcagggaagctcaaagccaactggtagcctgtctctcatactctaacatctaacagcaggccagcttgtacactaatttcatcttatttctctaattttatttacatttttacccctatttccctggctatttgtttatctgtttgtaaggcacctcaagtctttgttgagagggggtataaataaataaactattggtccctttcttgtcttataaggt

SEQ ID NO: 327430 - DNA, 1263 bp, Homo sapiens
cccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcccaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagtgagtggagcccctgatgcttccactcagactctggccctggagtcagaggcgccaggcaagaaaatcagcactgcctttcttgagctgtgtggccttgggcaagtcactatatctctctgagcctccgtttcattatcccaaaaaatgacaacaattactcctctcctttctgagagaatct

SEQ ID NO: 327431 - DNA, 2124 bp, Homo sapiens
catatagaggtgctttagctgaatcctgggtacagagttggccttgaacaaacatgagtccttctcttgcctccaagaattcatcagtatttatcacataatcactgtcatttgctctgtgtccataagaaaagtgtatatttgaggtcaagtggatgcaagatgagatgtggggaagaacccaggaaacgtttttaaatttaaactctctctggccatctgggatgcattcttaaaacattacatgcttatgcgaatggatgaagacagtatgttctgcaatcacatgtataaatataaatgatctatttcagaattgttactctgagcctaacacagtcttccccactttcagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgcctcactttactgaatgaatagggttttttttttctttccatactggattttgtcaggtagatttgtgatgagcaaaaagctggagaatataggtgcatgtaaggcacagctgaattcctgtgtcagggtccccagggccacccccaggatcgatgattggctagaagaactcagaattcagaagagctattatccttatggttatggtttattacagcaaaaggataaacattaaaatcagcaaaagaggccgggtggagtggctcacgcctgtaatcccagcactttgggaggccaaggcaggcagatcgcctgaggtcaggagttcgagaccagcctggccaacatggtgaaaccccgtctctactaaaaatacaaaaattacctgggcgtggtggtgtgcacctgtaatcccagctactcaggaggcttgaacctgggaggcggaggttgcagtgagcggagatcgtgccattatactccagcctgggtgacagagcaagactccatctcaaaataaaatcaacaaaagaaaaaggtgcatagggcagagtccgggagagaccggcctcaagcttccagttgtcatctcctggtagagtcttacagacacacttaattttcccagcaatgatatgtgacaacacgtactaaatattaccagccagaaagctcaccctagccttggggtctaggtttttattgcatgtcagtcacatagggcaatcacatgaccgactttagttacttaatcaccagctgctccagaggtcaaaatgatacagcatggcccaaggtccccaccataaatcacattattagcacaaactatctggcctggtatggcccaaggcctgaggtatacaaagacacccctacttgggaggatattccaaggacttagaggttatctcccaggagcccattaaggccagttttttctttgagatgtgctgggtttggacacttcaagcctgctgagttaacccttatagcacagtccccaaatgctgagggaccaactgggcctacaataagtttgtatctttaagggttaaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacaga

SEQ ID NO: 327432 - DNA, 3147 bp, Homo sapiens
cccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcccaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgcctcactttactgaatgaatagggttttttttttctttccatactggattttgtcaggtagatttgtgatgagcaaaaagctggagaatataggtgcatgtaaggcacagctgaattcctgtgtcagggtccccagggccacccccaggatcgatgattggctagaagaactcagaattcagaagagctattatccttatggttatggtttattacagcaaaaggataaacattaaaatcagcaaaagaggccgggtggagtggctcacgcctgtaatcccagcactttgggaggccaaggcaggcagatcgcctgaggtcaggagttcgagaccagcctggccaacatggtgaaaccccgtctctactaaaaatacaaaaattacctgggcgtggtggtgtgcacctgtaatcccagctactcaggaggcttgaacctgggaggcggaggttgcagtgagcggagatcgtgccattatactccagcctgggtgacagagcaagactccatctcaaaataaaatcaacaaaagaaaaaggtgcatagggcagagtccgggagagaccggcctcaagcttccagttgtcatctcctggtagagtcttacagacacacttaattttcccagcaatgatatgtgacaacacgtactaaatattaccagccagaaagctcaccctagccttggggtctaggtttttattgcatgtcagtcacatagggcaatcacatgaccgactttagttacttaatcaccagctgctccagaggtcaaaatgatacagcatggcccaaggtccccaccataaatcacattattagcacaaactatctggcctggtatggcccaaggcctgaggtatacaaagacacccctacttgggaggatattccaaggacttagaggttatctcccaggagcccattaaggccagttttttctttgagatgtgctgggtttggacacttcaagcctgctgagttaacccttatagcacagtccccaaatgctgagggaccaactgggcctacaataagtttgtatctttaagggttaaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacaga

SEQ ID NO: 327433 - DNA, 3094 bp, Homo sapiens
cccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcccaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgcctcactttactgaatgaatagggttttttttttctttccatactggattttgtcaggtagatttgtgatgagcaaaaagctggagaatataggtgcatgtaaggcacagctgaattcctgtgtcagggtccccagggccacccccaggatcgatgattggctagaagaactcagaattcagaagagctattatccttatggttatggtttattacagcaaaaggataaacattaaaatcagccaaggcaggcagatcgcctgaggtcaggagttcgagaccagcctggccaacatggtgaaaccccgtctctactaaaaatacaaaaattacctgggcgtggtggtgtgcacctgtaatcccagctactcaggaggcttgaacctgggaggcggaggttgcagtgagcggagatcgtgccattatactccagcctgggtgacagagcaagactccatctcaaaataaaatcaacaaaagaaaaaggtgcatagggcagagtccgggagagaccggcctcaagcttccagttgtcatctcctggtagagtcttacagacacacttaattttcccagcaatgatatgtgacaacacgtactaaatattaccagccagaaagctcaccctagccttggggtctaggtttttattgcatgtcagtcacatagggcaatcacatgaccgactttagttacttaatcaccagctgctccagaggtcaaaatgatacagcatggcccaaggtccccaccataaatcacattattagcacaaactatctggcctggtatggcccaaggcctgaggtatacaaagacacccctacttgggaggatattccaaggacttagaggttatctcccaggagcccattaaggccagttttttctttgagatgtgctgggtttggacacttcaagcctgctgagttaacccttatagcacagtccccaaatgctgagggaccaactgggcctacaataagtttgtatctttaagggttaaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacaga

SEQ ID NO: 327434 - DNA, 3070 bp, Homo sapiens
cccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcccaccccgaggtgcctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgcctcactttactgaatgaatagggttttttttttctttccatactggattttgtcaggtagatttgtgatgagcaaaaagctggagaatataggtgcatgtaaggcacagctgaattcctgtgtcagggtccccagggccacccccaggatcgatgattggctagaagaactcagaattcagaagagctattatccttatggttatggtttattacagcaaaaggataaacattaaaatcagcaaaagaggccgggtggagtggctcacgcctgtaatcccagcactttgggaggccaaggcaggcagatcgcctgaggtcaggagttcgagaccagcctggccaacatggtgaaaccccgtctctactaaaaatacaaaaattacctgggcgtggtggtgtgcacctgtaatcccagctactcaggaggcttgaacctgggaggcggaggttgcagtgagcggagatcgtgccattatactccagcctgggtgacagagcaagactccatctcaaaataaaatcaacaaaagaaaaaggtgcatagggcagagtccgggagagaccggcctcaagcttccagttgtcatctcctggtagagtcttacagacacacttaattttcccagcaatgatatgtgacaacacgtactaaatattaccagccagaaagctcaccctagccttggggtctaggtttttattgcatgtcagtcacatagggcaatcacatgaccgactttagttacttaatcaccagctgctccagaggtcaaaatgatacagcatggcccaaggtccccaccataaatcacattattagcacaaactatctggcctggtatggcccaaggcctgaggtatacaaagacacccctacttgggaggatattccaaggacttagaggttatctcccaggagcccattaaggccagttttttctttgagatgtgctgggtttggacacttcaagcctgctgagttaacccttatagcacagtccccaaatgctgagggaccaactgggcctacaataagtttgtatctttaagggttaaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacaga

SEQ ID NO: 327435 - DNA, 762 bp, Homo sapiens
tcctcaccagttcagggagcttttgccaggggagagacccccagagggctgggaccttggggaacaccccttagatgggacaaagcctggaggaagggactgagatgtgattgggtggggaaacataaggccaacagaagacctggagtcaaagttggacttgaaaaagtgggtctagggacaagggaaacctgctggccaccatcttcctgacaatcccctctcccccagctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggtaaccagggcaggggcacagtggcaagggcacggaagatgtgaacaggtttggaacccttcatccaggggatgccttcctccacaggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggtaagcacctgctctgcccaaggggaacacagaggccttcttgtactcagaggaa

SEQ ID NO: 327436 - DNA, 995 bp, Homo sapiens
  misc_feature (771)..(771): n is a, c, g, or t
tcaaccaaaccgggctaaggtacgaggcggtttaatcggccgaggcctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccantgagccagttggcgtgcaccaagagaaaaacttgatttgttccctttgcgccacagccgggggacaactccttcgcgcgcggcaattgtggggagccctcgctgggcgaagtgtttcgcttccgtaccctccgggggccgcgatgaggcagggggaggcatcttcttgtcagccagtcgggaggaagatttgggcggccctcgttggaggacccacatttccat

SEQ ID NO: 327437 - DNA, 529 bp, Homo sapiens
caaagggtctgaaaatgggatagccgaggtcttaggagagagagtaccagtcaagctcaccagaagggctggagttagggtccaaagaaaagggctgcctgtgactctgttcattggtgatctaggggtacccctggtatacgaggccttcaactggcgtcatggggtgtttgtgggcagcgccatgcgctctgagtccactgctgcagcagaacacaaaggtgagcaccctcaccattcctccctctcctgtgtgtgcacacagcacgtcctctctcccttcctgagccagaccttccttttgtccacccctggagtctgatatggccccacctcttcccacttctatcttttccccatccctgaagatattcagaaccataagcctttcacagcttcctctcccactcttttctcacatagctcagctggccgcaccttcatggctaaacaacctgagctcttggagatgccctggctcccctctctctgctccgtatcacacaaggttctaggcagctgatgaggc

SEQ ID NO: 327438 - DNA, 270 bp, Homo sapiens
catgtatgtgtgtgttgggggtcgacatgaccttggaaataatagtgtttgtatttcctctgccaggtgacaaggagccctgtgcacatcccaactctcgattttgtgccccggctcgccagtgccccatcatggacccagcctgggaggccccagagggtgtccccattgacgccatcatctttggtggccgcagacccaaaggtaaacaacatatgagctccatgttcttggcaaaagggctatctctgtattagggcctacctccct

SEQ ID NO: 327439 - DNA, 2202 bp, Homo sapiens
  misc_feature (36)..(36): n is a, c, g, or t
cgagtggcgccgaaaaggtaggctagtagaggctgngtgtgaatcggccgaggcctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327440 - DNA, 2194 bp, Homo sapiens
tcaaccaaaccgggctaaggtacgaggcggtttaatcggccgaggcctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327441 - DNA, 1899 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327442 - DNA, 1812 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaagagatggggtttcgtcacattgcccaggctgatctcaaattcctgtggtcaagcgagctgcccgcctcagcctctcaaagtactgggattacaggtgtgagctaccacgcctattatactttctaatgaaaaaatgaaaccacatcgtttttgcatctattacatgtcaccagaagaaatgattatctttatttttttaacttgacaatgtagtttgcacaatttcctatggtataaaaatagaaggctacaacaaacctataccaggaataggtaccttaaaaaaaaattgaagactacaacacc

SEQ ID NO: 327443 - DNA, 2146 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtatgtgcggtggggaaggtgtggcacagcctccaggcctcagcaccttaatggtggaaaagctttctccacaacctccaaccatcttctaggactgccaggaggcacagaagtcatgaacgtttgcagtttccagtcccaggcaaaatctcagttcatgtcccaactccaccagtcactggttttgtgatctggctaagttgctcaacttccctaagctttagtttccacatcagttgaatgagggtagttgtgatagtacctatctcatgagattgttggaggattaaatagtgcataaaaagggtttagcacactgacaaatacacagtaaattctcaataataaaaaaaaaaaaaaaaaaaaaaaaaaaaaaaaaaaaaaaagaaaaaaaaaaaaaaaaaaaaaaaaataaaaaaagaaaaatattatatgaaaaaaaaaaaaaaataaaatggaaaaaaatataaaaaaaccctgggcccaattcttattaaagttttttggacccccccaccctgggggggggcccgggccccaattggccctttagggggggggtttaaaattacctgggcgggggtttaaaagggtgggattgggaaaacccgggggttacccaatttaaatcccttgggaaaaattccctttttcgcaggttgggtaaatacaaaaaggcccgccccggtcgccttttccaaaagtttgccaaccttaatggggaaaggcaaatttgtaggcgtaattttttggtaaaaatccgggtaaatttttttt

SEQ ID NO: 327444 - DNA, 1751 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtatgtgcggtggggaaggtgtggcacagcctccaggcctcagcaccttaatggtggaaaagctttctccacaacctccaaccatcttctaggactgccaggaggcacagaagtcatgaacgtttgcagtttccagtcccaggcaaaatctcagttcatgtcccaactccaccagtcactggttttgtgatctggctaagttgctcaacttccctaagctttagtttccacatcagttgaatgagggtagttgtgatagtacctatctcatgagattgttggaggattaaatagtgcataaaaagggtttagcacactgacaaatacacagtaaattctcaataataaatacaggctggatttttttttaatgaaaggaaaa

SEQ ID NO: 327445 - DNA, 2274 bp, Homo sapiens
  misc_feature (36)..(36): n is a, c, g, or t
cgagtggcgccgaaaaggtaggctagtagaggctgngtgtgaatcggccgaggcctccccggctccgctcggttcctggccaccccgcagcccctgcccaggtgccatggccgcattgtaccgccctggcctgcggctaacaccctctgagtctgagctgccagcaagctgctgttccaccctcccaccaacaccaaagctctctaggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327446 - DNA, 2642 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggtgagtgacccccggcccggggcccacccgcaccttccgctgcgctcgccccctcggggctgccagtggcgctctcctgctctcagcctccgccaggtttcccatcctaggcggaggcgggcaggggcgactgctgtgggtccagcctcccgcgccgcgcgtctcttgggagggcagccggccggtgctcctcgtttccgcctgcacctccccttctctgcctcgctcgcctctgaccgcgcgatctctatctgccactctcagaacttcctctctctcctcgctcctctctgctgagccaggtctccgcatatcctcctttccttcccagatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327447 - DNA, 2150 bp, Homo sapiens
  misc_feature (60)..(60): n is a, c, g, or t
tttaagaactggggaaccaattggagtggcctagaaaaggcgcgccgattatgagggagnctagggggccaagttcgatttggcacggatgaagcgagttccgaatgaaacccttggacggacaaggtgggcgtatatgttcgtgtctgtattttcgtagcgtgtctctatcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327448 - DNA, 2077 bp, Homo sapiens
tttacgactcgtttcttgcccacgactcgtttacgactcgtttcttgcccacgactcgcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327449 - DNA, 2211 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327450 - DNA, 1083 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccttgtggaaaatgttgcctagaattcctggtggccgttaggtggtgcaaacacgtcacggtacaactagggagagtttgggctcagcgtggacaggtaagcactcggaagaggcgcgatctttaacacacactagttgtggcccacacgaaaaggaaaagcctacgtcgcccctcgcc

SEQ ID NO: 327451 - DNA, 1964 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327452 - DNA, 1032 bp, Homo sapiens
  misc_feature (808)..(808): n is a, c, g, or t
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccantgagccagttggcgtgcaccaagagaaaaacttgatttgttccctttgcgccacagccgggggacaactccttcgcgcgcggcaattgtggggagccctcgctgggcgaagtgtttcgcttccgtaccctccgggggccgcgatgaggcagggggaggcatcttcttgtcagccagtcgggaggaagatttgggcggccctcgttggaggacccacatttccat

SEQ ID NO: 327453 - DNA, 1030 bp, Homo sapiens
  misc_feature (24)..(24): n is a, c, g, or t
atgctagacgagcgggtaatcggncagggcctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccttgtggaaaatgttgcctagaattcctggtggccgttaggtggtgcaaacacgtcacggtacaactagggagagtttgggctcagcgtggacaggtaagcactcggaagaggcgcgatctttaacacacactagttgtggcccacacgaaaaggaaaagcctacgtcgcccctcgcc

SEQ ID NO: 327454 - DNA, 2231 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327455 - DNA, 2178 bp, Homo sapiens
  misc_feature (24)..(24): n is a, c, g, or t
atgctagacgagcgggtaatcggncagggcctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327456 - DNA, 2150 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327457 - DNA, 1911 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaaggtgagcaccctcaccattcctccctctcctgtgtgtgcacacagcacgtcctctctcccttcctgagccagaccttccttttgtccacccctggagtctgatatggccccacctcttcccacttctatcttttccccatccctgaagatattcagaaccataagcctttcacagcttcctctcccactcttttctcacatagctcagctggccgcaccttcatggctaaacaacctgagctcttggagatgccctggctcccctctctctgctccgtatcacacaaggttctaggcagctgatgaggc

SEQ ID NO: 327458 - DNA, 1718 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtatgtgcggtggggaaggtgtggcacagcctccaggcctcagcaccttaatggtggaaaagctttctccacaacctccaaccatcttctaggactgccaggaggcacagaagtcatgaacgtttgcagtttccagtcccaggcaaaatctcagttcatgtcccaactccaccagtcactggttttgtgatctggctaagttgctcaacttccctaagctttagtttccacatcagttgaatgagggtagttgtgatagtacctatctcatgagattgttggaggattaaatagtgcataaaaagggtttagcacactgacaaatacacagtaaattctcaataataaa

SEQ ID NO: 327459 - DNA, 2208 bp, Homo sapiens
ccggggccgagggagctggcctgccagcggggcggaggaaagctagtgccagccctaccagatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327460 - DNA, 2128 bp, Homo sapiens
ccggggccgagggagctggcctgccagcggggcggaggaaagctagtgccagccctaccaggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327461 - DNA, 2282 bp, Homo sapiens
  misc_feature (36)..(36): n is a, c, g, or t
cgagtggcgccgaaaaggtaggctagtagaggctgngtgtgaatcggccgaggcctccccggctccgctcggttcctggccaccccgcagcccctgcccaggtgccatggccgcattgtaccgccctggcctgcgatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327462 - DNA, 2052 bp, Homo sapiens
tcctcaccagttcagggagcttttgccaggggagagacccccagagggctgggaccttggggaacaccccttagatgggacaaagcctggaggaagggactgagatgtgattgggtggggaaacataaggccaacagaagacctggagtcaaagttggacttgaaaaagtgggtctagggacaagggaaacctgctggccaccatcttcctgacaatcccctctcccccagctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327463 - DNA, 2139 bp, Homo sapiens
tcctcaccagttcagggagcttttgccaggggagagacccccagagggctgggaccttggggaacaccccttagatgggacaaagcctggaggaagggactgagatgtgattgggtggggaaacataaggccaacagaagacctggagtcaaagttggacttgaaaaagtgggtctagggacaagggaaacctgctggccaccatcttcctgacaatcccctctcccccagctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggtaaccagggcaggggcacagtggcaagggcacggaagatgtgaacaggtttggaacccttcatccaggggatgccttcctccacaggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327464 - DNA, 2097 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcaggcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacaaaaaaattgt

SEQ ID NO: 327465 - DNA, 941 bp, Homo sapiens
tgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcccgtgggcagctgggcaactggatgtccccagctgatttccagcgagctgtggatgagaggtttccaggctgcatgcagggtaaccagggcaggggcacagtggcaagggcacggaagatgtgaacaggtttggaacccttcatccaggggatgccttcctccacaggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggtaagcacctgctctgcccaaggggaacacagaggccttcttgtactcagaggaa

SEQ ID NO: 327466 - DNA, 1714 bp, Homo sapiens
gacaagtgtcttttcctgaaattgctaagtgtatttggcagtactttactacttgtggatagaactgagagtgaggtcagtatcaccaagcctcttggatttcttcagtagtctcatggataagtgaatgtttaaagtaactactactttgttggctcttggttgggtggatggattctcagtcctggtgtttttaaaaatctcattccagccgggcgcggtggctcacgcctgtaatcctagcactttgggaggctgaggcgggcagatcacctgaggtcaggaattcgaaaccagccttaccaacatggcaaaacccatctctattaaaaatacaaaaattagccgggtgtggtggcacgtgcctgtaatcccagctactcgggaggctgaggcaggagaatcacttgaaccctggaggtggtggttgcaatgagccgagattgcgccattgcactctagcctgggtgacagagcgagactccgtctcaaaaaaaaaaaaaaatcgcattccgtctaaagcaagctacaaaatgtgattatttatgtcacgatatgacccagccataaatgtacttcaggtaagaaggacactgacatgatatcttactgatcaaatgcagtcagtaggtatatatgaacttttttctctgtgaagaaaagctattaataagtttgacttaataggcctatagtatgcacatactggccaagattctaaatggattattcagcggttctgtttttgtggaggtgcttattctcatttctccaaagccttaagattcctgggaatagaggaaatgttgctgccaccagctttgctggtgaatttcaaagagaataggtgtttgctgtttgatttctagtgaccttttggcgagctctgatttataggtagaacatttgtgtttcttttcattttgaggccaggtggtagagtggaaagactgggagctgtcaggaaaccaaggcttggatctccactctgttatgtaccagctggggcaaatcagggcccattcccaactcctttaaaatgaaaggactagacttggtctttaagctcccttccgattctaacatttggtggtagcaggattgtgcacaaagctcctaatttagagaaagatctgggttttagtcttttctcctctatcgccgccttaccggttgtacaacattggaccagccattctccccaaggcctcggcattttcattgttaaatgggaacactcctaattcacactgttgctgtgaggattacatttggtaatgaatgatagaatgctttgtacatggaaaaggactatacctttcttttttaactacaaaggcgaacatgtaaccctctacctgtgggcgcacatttgctgtggtgttacgttccactggtagcgcccaacctcccttcattcaagcacattttacgggcctacagggaaggttttcttcctgtcctctcctaagacttgtttatgttcatcatctcttctatactagagctgcagtcttacatttgcttacttcctgacatccacccccaccccagtgatttctccccatctccacctctatattatttgaactaaatgaattcatgaatgaacaaatgagtggatgaatgaatggtaatggataatgggctatgaagtcatatttaaaggcactatctcatttaaaaacaatctaaataaataactacaatgata

SEQ ID NO: 327467 - DNA, 2320 bp, Homo sapiens
gacaagtgtcttttcctgaaattgctaagtgtatttggcagtactttactacttgtggatagaactgagagtgaggtcagtatcaccaagcctcttggatttcttcagtagtctcatggataagtgaatgtttaaagtaactactactttgttggctcttggttgggtggatggattctcagtcctggtgtttttaaaaatctcattccagccgggcgcggtggctcacgcctgtaatcctagcactttgggaggctgaggcgggcagatcacctgaggtcaggaattcgaaaccagccttaccaacatggcaaaacccatctctattaaaaatacaaaaattagccgggtgtggtggcacgtgcctgtaatcccagctactcgggaggctgaggcaggagaatcacttgaaccctggaggtggtggttgcaatgagccgagattgcgccattgcactctagcctgggtgacagagcgagactccgtctcaaaaaaaaaaaaaaatcgcattccgtctaaagcaagctacaaaatgtgattatttatgtcacgatatgacccagccataaatgtacttcaggtaagaaggacactgacatgatatcttactgatcaaatgcagtcagtaggtatatatgaacttttttctctgtgaagaaaagctattaataagtttgacttaataggcctatagtatgcacatactggccaagattctaaatggattattcagcggttctgtttttgtggaggtgcttattctcatttctccaaagccttaagattcctgggaatagaggaaatgttgctgccaccagctttgctggtgaatttcaaagagaataggtgtttgctgtttgatttctagtgaccttttggcgagctctgatttataggtagaacatttgtgtttcttttcattttgaggccaggtggtagagtggaaagactgggagctgtcaggaaaccaaggcttggatctccactctgttatgtaccagctggggcaaatcagggcccattcccaactcctttaaaatgaaaggactagacttggtctttaagctcccttccgattctaacatttggtggtagcaggattgtgcacaaagctcctaatttagagaaagatctgggttttagtcttttctcctctatcgccgccttaccggttgtacaacattggaccagccattctccccaaggcctcggcattttcattgttaaatgggaacactcctaattcacactgttgctgtgaggattacatttggtaatgaatgatagaatgctttgtacatggaaaaggactatacctttcttttttaactacaaaggcgaacatgtaaccctctacctgtgggcgcacatttgctgtggtgttacgttccactggtagcgcccaacctcccttcattcaagcacattttacgggcctacagggaaggttttcttcctgtcctctcctaagacttgtttatgttcatcatctcttctatactagagctgcagtcttacatttgcttacttcctgacatccacccccaccccagtgatttctccccatctccacctctatattatttgaactaaatgaattcatgaatgaacaaatgagtggatgaatgaatggtaatggataatgggctatgaagtcatatttaaaggcactatctcatttaaaaacaatctaaataaataactacaatgataaaaaaaaacaaaccaccacacaccccccaacacccgcacacccaaacccaaacacaacagaaggggcgcccccccccaaagaactacacaccgccggggggacaccccccaaattaccgcccaccccccccatctcttctcgacgaccccagacgggcccccccacaaagcgcgcgcgcccctcacacaacacccccgcacgacagggccagcacttcataacacacgcctcccgaccgcgacacacgccactcacccgagccaacccctgccacaagaacaccccaacccactgcgcgggaacaaaaccgagagcaaccaacccacctcaataattgaagccacccggaggcaaaaccaacacacgcccaggggcaccacggggacaacacagccgccacactcgacgccgcagacacaaccccccccgacgcactccccacaacacacaccgccgccagccaaccacccgacacacgcgacgccgccacgacacacgagcgcacgccccgacccccacgcacgcccccaacagccacacgccaacacgactggccacaccacacaccgacaccgaccccagtacccaagacacacgacgaaaca

SEQ ID NO: 327468 - DNA, 2266 bp, Homo sapiens
gacaagtgtcttttcctgaaattgctaagtgtatttggcagtactttactacttgtggatagaactgagagtgaggtcagtatcaccaagcctcttggatttcttcagtagtctcatggataagtgaatgtttaaagtaactactactttgttggctcttggttgggtggatggattctcagtcctggtgtttttaaaaatctcattccagccgggcgcggtggctcacgcctgtaatcctagcactttgggaggctgaggcgggcagatcacctgaggtcaggaattcgaaaccagccttaccaacatggcaaaacccatctctattaaaaatacaaaaattagccgggtgtggtggcacgtgcctgtaatcccagctactcgggaggctgaggcaggagaatcacttgaaccctggaggtggtggttgcaatgagccgagattgcgccattgcactctagcctgggtgacagagcgagactccgtctcaaaaaaaaaaaaaaatcgcattccgtctaaagcaagctacaaaatgtgattatttatgtcacgatatgacccagccataaatgtacttcaggtaagaaggacactgacatgatatcttactgatcaaatgcagtcagtaggtatatatgaacttttttctctgtgaagaaaagctattaataagtttgacttaataggcctatagtatgcacatactggccaagattctaaatggattattcagcggttctgtttttgtggaggtgcttattctcatttctccaaagccttaagattcctgggaatagaggaaatgttgctgccaccagctttgctggtgaatttcaaagagaataggtgtttgctgtttgatttctagtgaccttttggcgagctctgatttataggtagaacatttgtgtttcttttcattttgaggccaggtggtagagtggaaagactgggagctgtcaggaaaccaaggcttggatctccactctgttatgtaccagctggggcaaatcagggcccattcccaactcctttaaaatgaaaggactagacttggtctttaagctcccttccgattctaacatttggtggtagcaggattgtgcacaaagctcctaatttagagaaagatctgggttttagtcttttctcctctatcgccgccttaccggttgtacaacattggaccagccattctccccaaggcctcggcattttcattgttaaatgggaacactcctaattcacactgttgctgtgaggattacatttggtaatgaatgatagaatgctttgtacatggctgtgggcgcacatttgctgtggtgttacgttccactggtagcgcccaacctcccttcattcaagcacattttacgggcctacagggaaggttttcttcctgtcctctcctaagacttgtttatgttcatcatctcttctatactagagctgcagtcttacatttgcttacttcctgacatccacccccaccccagtgatttctccccatctccacctctatattatttgaactaaatgaattcatgaatgaacaaatgagtggatgaatgaatggtaatggataatgggctatgaagtcatatttaaaggcactatctcatttaaaaacaatctaaataaataactacaatgataaaaaaaaacaaaccaccacacaccccccaacacccgcacacccaaacccaaacacaacagaaggggcgcccccccccaaagaactacacaccgccggggggacaccccccaaattaccgcccaccccccccatctcttctcgacgaccccagacgggcccccccacaaagcgcgcgcgcccctcacacaacacccccgcacgacagggccagcacttcataacacacgcctcccgaccgcgacacacgccactcacccgagccaacccctgccacaagaacaccccaacccactgcgcgggaacaaaaccgagagcaaccaacccacctcaataattgaagccacccggaggcaaaaccaacacacgcccaggggcaccacggggacaacacagccgccacactcgacgccgcagacacaaccccccccgacgcactccccacaacacacaccgccgccagccaaccacccgacacacgcgacgccgccacgacacacgagcgcacgccccgacccccacgcacgcccccaacagccacacgccaacacgactggccacaccacacaccgacaccgaccccagtacccaagacacacgacgaaaca

SEQ ID NO: 327469 - DNA, 585 bp, Homo sapiens
cgtattcccaccttagttactccattcattagctcattgcaaaagtgctggggtggccaaattcagagtcacttagccagttattctgtccacttggttagttaatgactcttgcctagtagatgctttctgttttatactaactagcctgtgataccaacaaattcacacttcatgcctactcccatgtgtccatccacatgtcactacatgaaaactccttgtctcctaccttacaatcttgcttattccaagccccaaccaatcagctaagccatttgccactgctcatgaatccatatatattcttacctttggctgcttctccttttacacaattgataatcatttgcactgcccttcatggactctcacatccacagtcatttatactcacacgcactcacacgcacacgtgcactccccaccaccttcattcacggaggagggggctgggcccaagcggctgccagctgtcctgagctcaccctgctggctgcagcacaggggctgcagtggagtcagatccaatgttcacactcttccttcactccactctccccaaaacacttttactgggataca

SEQ ID NO: 327470 - DNA, 340 bp, Homo sapiens
ttccaggccctactttccagatgacattttgagacacacactggtgcaaaagaacctgctgcctcgaagggaaggacctagtcctggcaggattaatcacctgctgactaaggagcccttgggccctgaatagccagcagtgatacccagggaccacactgtgggcattgggctctgagatgtgctgacttcaggggtgactcagcacattcccagctgtggtggctatggtgaaagactcctgtttgataaaagcttttattaaagactgtatgtctttataggtggacaccatttctggacctgccctgggtcagaggagagcctactgccctgaaag

SEQ ID NO: 327471 - DNA, 197 bp, Homo sapiens
atttacaaagtgtttatgaccacaaaacagaaaatccaccccagggccactggaactaagataaccatttaaactacttatccaaaatagtacgctgtgatctttttatatttgactggtgttagtgattccctaggccaaatagggatgattgcattaactgcatttttgccttagcagaaagctgtaatgcaaag

SEQ ID NO: 327472 - DNA, 309 bp, Homo sapiens
tgtgagcttaatccataaagctgtttccctccaaaggtgtcagctgcatggcgtgggaggtcaggcaagtgggtctgtgttccccagggtgggagaagcattagtagaaacaggtgatgaattccttaattaggatagggaaacactgcagaagagctgtggtctagggattttatgaaatgcaaagcttggaaaattaaagaagcccaatgtgaagaagttaggaggcaggatcaaggtggctgtgaaaacagagaagaaaaacttagagctccttttggagaaaatgggatattagggctaaatttg

SEQ ID NO: 327473 - DNA, 1774 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgca

SEQ ID NO: 327474 - DNA, 704 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacctcgtttctgaaatactgatggtggctttatacagttctgctgagtctaaaggattccactactataattgtcttctggttagtagatcgatcgcacagtga

SEQ ID NO: 327475 - DNA, 803 bp, Homo sapiens
cccacgcgtccgctcttacctagcgaatgagtacacatataatcacaaatgcacactgatcatgactttatttaaaaattagcaaacaatactgtagaaatattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaaaaaaaaagaaaaacgaatacacaactaacagattgaacgaagacgaaacaaacaacaaaaagcgggggggcggcgccaaacaaaaaatatctgctcacaggagcggccaacaattacatcaggcacccaacgtattttgtagacacaagggggcccaacaaaagagagagcgataataacaacacaactgcaagagggacggagataacaacaccggagaacggagaaacaagcggcatccgggcatacttgagaaaaagacacaccaataccggggggggacatctagtaggaacacccccacaaaaataaaagcgccaaggaaacaaaagttggcggctctagcagtaacaccacgaaaatcgcgagtaaaaaatctgccggcagtcgttcaaaattccg

SEQ ID NO: 327476 - DNA, 2597 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgctttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaacaaaacaaaacaaaaccaaaaccaacgaaaaaacaccacaaaaaaaacaaaccaaacaaacccacaaaaaaaaaaaaaacaacaagacaacccaacattaatacaccaactcaccccacgcaaccacacatgcatctacaccacatccaatcccaacaaaccgacaaatacaccaaccaaccaatctaaatcacaaaaccacacttcactcacgaaacacactcaaacacaacaaaaacaccaacagcacaacacagacaatactcccccaccaaaaacacacacacaccaccccaacacacaccacaatccaacaacaactcacacccaacgaaacactcaccataacaacacacacacacaaccatatacacacacgggacaccccagccacacacaaaaccaaggaccaaacacccagaggatgcccaatcaagaagaacactaaccacaccacgcacaacacagcccaatcaccgcaaactacagaggaacaaaacaagaaccaccatgagacacacccacaccacgcacaaccaaaaagctatccccacaatacctccccccacaccagaacaaccagctctgcgaaacaaaaggaaccaaaagcaccgcaccccgccg

SEQ ID NO: 327477 - DNA, 2609 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaacaaaacaaaacaaaaccaaaaccaacgaaaaaacaccacaaaaaaaacaaaccaaacaaacccacaaaaaaaaaaaaaacaacaagacaacccaacattaatacaccaactcaccccacgcaaccacacatgcatctacaccacatccaatcccaacaaaccgacaaatacaccaaccaaccaatctaaatcacaaaaccacacttcactcacgaaacacactcaaacacaacaaaaacaccaacagcacaacacagacaatactcccccaccaaaaacacacacacaccaccccaacacacaccacaatccaacaacaactcacacccaacgaaacactcaccataacaacacacacacacaaccatatacacacacgggacaccccagccacacacaaaaccaaggaccaaacacccagaggatgcccaatcaagaagaacactaaccacaccacgcacaacacagcccaatcaccgcaaactacagaggaacaaaacaagaaccaccatgagacacacccacaccacgcacaaccaaaaagctatccccacaatacctccccccacaccagaacaaccagctctgcgaaacaaaaggaaccaaaagcaccgcaccccgccg

SEQ ID NO: 327478 - DNA, 1957 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatcggggtcacggggaagacatctaacctccagtggcttatggcgtcaaagtggtggtccttggcgccacactcaatttaagaagtccggacttttcgaaacttccccttatcccgggtctctaccagtatgggtcggccacattcttcacaataaaggtctgtgaaccacgcgtgcactcgggcgaccgcattgtgtaccccattcttcttacctagcgaaccaggatctttcccaagtgggcgcttctaaaaaaacgcttggttcccacaagtggccggtgggacaatttaaggcccgggggaaaggacatgggcccttccggttggggccat

SEQ ID NO: 327479 - DNA, 2519 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcaggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaacaaaacaaaacaaaaccaaaaccaacgaaaaaacaccacaaaaaaaacaaaccaaacaaacccacaaaaaaaaaaaaaacaacaagacaacccaacattaatacaccaactcaccccacgcaaccacacatgcatctacaccacatccaatcccaacaaaccgacaaatacaccaaccaaccaatctaaatcacaaaaccacacttcactcacgaaacacactcaaacacaacaaaaacaccaacagcacaacacagacaatactcccccaccaaaaacacacacacaccaccccaacacacaccacaatccaacaacaactcacacccaacgaaacactcaccataacaacacacacacacaaccatatacacacacgggacaccccagccacacacaaaaccaaggaccaaacacccagaggatgcccaatcaagaagaacactaaccacaccacgcacaacacagcccaatcaccgcaaactacagaggaacaaaacaagaaccaccatgagacacacccacaccacgcacaaccaaaaagctatccccacaatacctccccccacaccagaacaaccagctctgcgaaacaaaaggaaccaaaagcaccgcaccccgccg

SEQ ID NO: 327480 - DNA, 1791 bp, Homo sapiens
gaattcccgggtgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaacaaaacaaaacaaaaccaaaaccaacgaaaaaacaccacaaaaaaaacaaaccaaacaaacccacaaaaaaaaaaaaaacaacaagacaacccaacattaatacaccaactcaccccacgcaaccacacatgcatctacaccacatccaatcccaacaaaccgacaaatacaccaaccaaccaatctaaatcacaaaaccacacttcactcacgaaacacactcaaacacaacaaaaacaccaacagcacaacacagacaatactcccccaccaaaaacacacacacaccaccccaacacacaccacaatccaacaacaactcacacccaacgaaacactcaccataacaacacacacacacaaccatatacacacacgggacaccccagccacacacaaaaccaaggaccaaacacccagaggatgcccaatcaagaagaacactaaccacaccacgcacaacacagcccaatcaccgcaaactacagaggaacaaaacaagaaccaccatgagacacacccacaccacgcacaaccaaaaagctatccccacaatacctccccccacaccagaacaaccagctctgcgaaacaaaaggaaccaaaagcaccgcaccccgccg

SEQ ID NO: 327481 - DNA, 1320 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaaagctcgtcataccaggcgtattatacatagccgcctagttttaagagtactgcggcaagtactattgacccagcgatgggggttcgacatgggctttagggt

SEQ ID NO: 327482 - DNA, 430 bp, Homo sapiens
ggctgcgggggtaggcggtgtgaagcgaattatgtaaagaggtaatgaagcgcaccgttgtcaaaccccaagggagagttgtggctcttgtctcccgctgttagtctgcacatcatactgtctttgaagcaaggagttgattttagtctatgtatctaaagttgaaatgtttaggtcctttaccttttcaaacgtgttgcccgtattagacaacagtttgctaacaatttttttagagagcagaaaggtgaatggtttgtgtatgattgagtgcaaacctcaccaactgaaaagtttgtaacaagttactgtttccttccttccaggatttacaaaccgaactttaggaaacttcagaggaatgggcatgtccaaaatgttggatgtgatgtgatactttggcctggttgtgcacattcattgtaattcc

SEQ ID NO: 327483 - DNA, 917 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggtaagcaatacctt

SEQ ID NO: 327484 - DNA, 2657 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaacaaaacaaaacaaaaccaaaaccaacgaaaaaacaccacaaaaaaaacaaaccaaacaaacccacaaaaaaaaaaaaaacaacaagacaacccaacattaatacaccaactcaccccacgcaaccacacatgcatctacaccacatccaatcccaacaaaccgacaaatacaccaaccaaccaatctaaatcacaaaaccacacttcactcacgaaacacactcaaacacaacaaaaacaccaacagcacaacacagacaatactcccccaccaaaaacacacacacaccaccccaacacacaccacaatccaacaacaactcacacccaacgaaacactcaccataacaacacacacacacaaccatatacacacacgggacaccccagccacacacaaaaccaaggaccaaacacccagaggatgcccaatcaagaagaacactaaccacaccacgcacaacacagcccaatcaccgcaaactacagaggaacaaaacaagaaccaccatgagacacacccacaccacgcacaaccaaaaagctatccccacaatacctccccccacaccagaacaaccagctctgcgaaacaaaaggaaccaaaagcaccgcaccccgccg

SEQ ID NO: 327485 - DNA, 2514 bp, Homo sapiens
cacaaaggagggctgcctgtggtttaattcccattaacctcccgggagcccaagcatgtcaggattgccaccgcaccgtccgaccgctggtggaaggcactggcattgtcagagctggaacatcccggggctgcgggggtaggcggtgtgaagcgaattatgtaaagagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaacaaaacaaaacaaaaccaaaaccaacgaaaaaacaccacaaaaaaaacaaaccaaacaaacccacaaaaaaaaaaaaaacaacaagacaacccaacattaatacaccaactcaccccacgcaaccacacatgcatctacaccacatccaatcccaacaaaccgacaaatacaccaaccaaccaatctaaatcacaaaaccacacttcactcacgaaacacactcaaacacaacaaaaacaccaacagcacaacacagacaatactcccccaccaaaaacacacacacaccaccccaacacacaccacaatccaacaacaactcacacccaacgaaacactcaccataacaacacacacacacaaccatatacacacacgggacaccccagccacacacaaaaccaaggaccaaacacccagaggatgcccaatcaagaagaacactaaccacaccacgcacaacacagcccaatcaccgcaaactacagaggaacaaaacaagaaccaccatgagacacacccacaccacgcacaaccaaaaagctatccccacaatacctccccccacaccagaacaaccagctctgcgaaacaaaaggaaccaaaagcaccgcaccccgccg

SEQ ID NO: 327486 - DNA, 1975 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttaacagtaggggatcgggttccccctggaagataactcaggcttatggtaagtggtcttgccaccccaaatttaagaagccgccttctcgaaaattcacatactcagggtcctaccgcatgggggtaattctaacaaagcctgaccaggggcatgggatattggtgtcacccctgaccagcgacagatctccgaggggtcccacagcagggcacacggcgggcgctcgcggggagcttgccccggtggcacgtacgacgagccgcccagatttggatcacgaaaccccgtgtctaacttgcggcaaaacagcacaaaaacaaggcccacacggcggatgtatgtcgccgcgcctacttccaccgagcgagacag

SEQ ID NO: 327487 - DNA, 2118 bp, Homo sapiens
tctagtttgggcccctttgtctatggacatatcatttctttgttgttccttctgtgaaactctgttggccttttcagttagtgtgcatgtttctgtctaggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaacaaaacaaaacaaaaccaaaaccaacgaaaaaacaccacaaaaaaaacaaaccaaacaaacccacaaaaaaaaaaaaaacaacaagacaacccaacattaatacaccaactcaccccacgcaaccacacatgcatctacaccacatccaatcccaacaaaccgacaaatacaccaaccaaccaatctaaatcacaaaaccacacttcactcacgaaacacactcaaacacaacaaaaacaccaacagcacaacacagacaatactcccccaccaaaaacacacacacaccaccccaacacacaccacaatccaacaacaactcacacccaacgaaacactcaccataacaacacacacacacaaccatatacacacacgggacaccccagccacacacaaaaccaaggaccaaacacccagaggatgcccaatcaagaagaacactaaccacaccacgcacaacacagcccaatcaccgcaaactacagaggaacaaaacaagaaccaccatgagacacacccacaccacgcacaaccaaaaagctatccccacaatacctccccccacaccagaacaaccagctctgcgaaacaaaaggaaccaaaagcaccgcaccccgccg

SEQ ID NO: 327488 - DNA, 2595 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaacttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcaaaaaaaaacaaaacaaaacaaaaccaaaaccaacgaaaaaacaccacaaaaaaaacaaaccaaacaaacccacaaaaaaaaaaaaaacaacaagacaacccaacattaatacaccaactcaccccacgcaaccacacatgcatctacaccacatccaatcccaacaaaccgacaaatacaccaaccaaccaatctaaatcacaaaaccacacttcactcacgaaacacactcaaacacaacaaaaacaccaacagcacaacacagacaatactcccccaccaaaaacacacacacaccaccccaacacacaccacaatccaacaacaactcacacccaacgaaacactcaccataacaacacacacacacaaccatatacacacacgggacaccccagccacacacaaaaccaaggaccaaacacccagaggatgcccaatcaagaagaacactaaccacaccacgcacaacacagcccaatcaccgcaaactacagaggaacaaaacaagaaccaccatgagacacacccacaccacgcacaaccaaaaagctatccccacaatacctccccccacaccagaacaaccagctctgcgaaacaaaaggaaccaaaagcaccgcaccccgccg

SEQ ID NO: 327489 - DNA, 1686 bp, Homo sapiens
  misc_feature (1662)..(1662): n is a, c, g, or t
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtactttagaaaattgggttaggagcaatcatttacctttgaggacttcacgcaaaatggcctagagcggcaagtatgcccacgcgaatacaccacgcccaataagatacacagcactgtgcagggggaccctcagcgacacttgacgaaactacctgtatacaccatataggggctgcaacacacgagcaacagttctgatagacagatgcgctccaacacaacccaccttgcacggacgcagacacagaataaacgataagagatgtctcatcaaacctgctgcctgtgtactcctttctgctctntactcgtcgctctactcgcgaagc

SEQ ID NO: 327490 - DNA, 905 bp, Homo sapiens
gcggcctgggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttattagtgcccatctgcagactaattgtggtctggtcaaaaggtttgtcagtttgcattttgggatcataaagatgccgtcgacgc

SEQ ID NO: 327491 - DNA, 591 bp, Homo sapiens
ctttgatgacacagtgtctcagattactctgttgaatggaagtaccagtggatttggggcaggaagcctgggttttggccctaatgcagctgttctcagtgactttgagggagttgctaggaagctgggtcatacaatctctgaggctccttcctggctagatttggtgatctttgtaccgcaactttgtgaataatatttcttcagagatatcattgattaaattacttcagttgttacttagcttgttagttaaacgttttgaatggtatctaatgcttagagacttagttgttccactgtcatataatagtgatttaataagatgcacctccttctggaaaaacattcatgtatttcactgagagcaagtttacttgtgtcaccagtcacttttgtggccttggaaggtttacttattttctcagtgcctgcaaaaccaggtgtgtgtggattaacatgttttaggtcacagagaaccttttcgaaaactgtgcactctctgtccatggaaatccttattactctcaagattttgcatgtaacctcaggaagttaaatggaagcaatctacccaaggctccccagtta

SEQ ID NO: 327492 - DNA, 311 bp, Homo sapiens
attaaaatgaagacagacataaaataatatttgatctaaattcattttcctatttctaggtctatgtaagttctgactttgcttatataaccgttcattactttttagacaacattcttttactaaatttctagtataatggcttttgttttccttctagttcataacatttatttaggttttctttaatgcctgtcaataaaatttacaatttttttccactaaaattttttgtagattaaaacttaatgtactttatattcttactacgactgggaaaatcatctttctgaaacattattttctaattg

SEQ ID NO: 327493 - DNA, 633 bp, Homo sapiens
agcggaagaggcggtgagaggctggcgactgggttgggcgcggcagagatgcattaggggtcccgatcccgggccccgcggttagaggaagaggagggcggctagaggaggggaagagcttcccttactccagccgaaaggatgcagttttgctgcatttaaattaagtgctgctcttcagctttgtgtacagctataagtgcacattggaatttatatgtatatatatatagagagagagagagagagagaaaatgactgctggttcagtgtgtgtccctcagatcataccactacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcagg

SEQ ID NO: 327494 - DNA, 300 bp, Homo sapiens
gattaggaggtggggcctttgggaggtgatgaggtcacgaaggtggagtctcatgaatgggatgagtgcccttacaaaaggggccccagagagccccctcgccccttccaccatgtgaggacacagcgagaaggcgccgtctacgaaccaggaagctggttccctccaggtacagaatctgtcgcacctcgatctcggacttccagcctccagagctgtgagccatgaatgtctgctgttgaggctgcccagtctatgagtgtgtgttagtgcagcccgcactggctgagacgacatgta

SEQ ID NO: 327495 - DNA, 402 bp, Homo sapiens
ccacagcttggaagagatagagttgaaatgcaaaaccgagttgaaatttaaaaccaacttatctgattccaaaaccagtacagagcaccgaggccttgatttgataggctatggagtttgaatttaattcagaagacagtggacagccactgatagtatttgaacagggcaatgataggatcagtgctgtgtctaggaagattgttcttgaaatgacagagagctttagaatggtgaaagactaaagactagttagaagtctgctgtaatggttccaactccagagacatagaaaagataggtctccaaagacaagtgatggcatagtctttgctcagccagagtctctaggaaaatggtggtgccgttaactgaaataggttaagttaagagaggttattg

SEQ ID NO: 327496 - DNA, 2203 bp, Homo sapiens
gagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttgcagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaacaaaaaaaaaaaagaagaagaagccgaaacacacaaacaacaagaagcaagaaacaacaaactctggttgggcgcgggcgaggcccccctagaaaagaagtcttgaagaaaaaccacatagagtgaggggcgcggcccccaatgtagggtacagaaaacacggggcaacaaacgtggtccacgagagaaccctggggaaacacgaggcggggaggacacccaaaaaaaaagacccggggaaacacggggtagaaacaca

SEQ ID NO: 327497 - DNA, 893 bp, Homo sapiens
tttgggcccaaaggaccaaaaattcggcaacgaggcttgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaacaaaaaaaaaaaagaagaagaagccgaaacacacaaacaacaagaagcaagaaacaacaaactctggttgggcgcgggcgaggcccccctagaaaagaagtcttgaagaaaaaccacatagagtgaggggcgcggcccccaatgtagggtacagaaaacacggggcaacaaacgtggtccacgagagaaccctggggaaacacgaggcggggaggacacccaaaaaaaaagacccggggaaacacggggtagaaacaca

SEQ ID NO: 327498 - DNA, 385 bp, Homo sapiens
ctcattgtttaaaaaacaaaaacaaaaaaaacctaatctgtgaaatcagcgtagcatgcctggagcatcaggaatggcagaaaagtctgatgcgctctagacagcttcaccactcgtttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgt

SEQ ID NO: 327499 - DNA, 578 bp, Homo sapiens
aaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaac

SEQ ID NO: 327500 - DNA, 2750 bp, Homo sapiens
gagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttgcagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaacaaacagtttgttgtttttatttctcatagcaaagcttcttttgtaaagaactccagcttccttttactcatgagcatccgtggaagagcaagtgcccaggttacatttgttctagatggaggtcatttagctctcattgcagacactgctgaaaacattgtgcagctttgctagggaagaaagtggtgtggcctgctgagaaatgagcggctcctccccatctcacccccagcacacgcagggactactacctgagtctgcaaaacacatagcatttttgtccgtggatggtacacaaagctcaatctttttgttttcttctggggaaaaaattaaatctttatatgttaatatgattgatattcattgtgcaaaaaaaatcagtgtgtttttaaagaagtataagggaaaaggaaaactcatatgtccttctgtcactctgagacatacactggtaacatctgtgcaagcccctttccaggattctgaatgtacagtatatatgaatgcatacacagagaaatttacattccaagagtgtactatacttgttcttctataacatcagaaataggtttttactcagatgtcttcatgtcggtaattatagaactacataattatttttatagctgtattatgtagatttaacaggttcctcattgataaaacaatgtttttttggttgtttattcagtatctgaataacgtttctatggacatccgtaaacatgtatgaggggacttttaaaagttcatggaaaatggaattaaaagaaaaataaaaaaatataaactttaattc

SEQ ID NO: 327501 - DNA, 114 bp, Homo sapiens
ggcctcctcagggacctctgggtcccctagctctgcgctttcacacacacatacccctcctgggtaccatcagtctaactgcaaggcccagcatttccaaagcaaacactgctc

SEQ ID NO: 327502 - DNA, 1454 bp, Homo sapiens
tgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacaggagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagagttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatga

SEQ ID NO: 327503 - DNA, 1545 bp, Homo sapiens
ggcggcgcaggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcc

SEQ ID NO: 327504 - DNA, 897 bp, Homo sapiens
ggcggcgcaggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggtttcccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagcctttggatcaattggtccatactgcctattgtgaaataacctaagctggttaaaaacaaaaaccacaaaaccaaaaaacaacaaaaaaaaacaaaacacaaaaaacaacgcgcgccgaaaaacgccgaaaggcccaaacccaacacgcaccgtctcaaacacccccgc

SEQ ID NO: 327505 - DNA, 1214 bp, Homo sapiens
ggcggcgcaggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtcttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagagttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatga

SEQ ID NO: 327506 - DNA, 1717 bp, Homo sapiens
tgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacaggagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagagttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtcttaagtagtgttcagggcagggtgttaccattcatgcttgacttctagccagtgtgacgagaggct

SEQ ID NO: 327507 - DNA, 1588 bp, Homo sapiens
ggcggcgcaggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggtttcccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcc

SEQ ID NO: 327508 - DNA, 1672 bp, Homo sapiens
ggcggcgcaggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggtttcccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcc

SEQ ID NO: 327509 - DNA, 1535 bp, Homo sapiens
ggcggcgcaggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggtttcccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcagatgcgtctgaagaaacatcgctggtataagaaaatccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcc

SEQ ID NO: 327510 - DNA, 477 bp, Homo sapiens
tgttcatgttaatgctatgtttattacagataacagcatacaggtttcccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaagg

SEQ ID NO: 327511 - DNA, 1635 bp, Homo sapiens
tctagtgatgggaacagtgagaatcagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggtttcccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcc

SEQ ID NO: 327512 - DNA, 720 bp, Homo sapiens
gctttcataggtagcttcttcttgaatggtaataataaggtgttttgtgatactaattttaaattattgatttctgtgaattttaaatgatgaatttatatgaatgggaatggaaattatattgcctttttattgtgaaggtcgtcttgtaggataggactatagagagagcagaaggaattttgaatatctgatattattgctgacaaatattttagaaaaactatataataggttaaagtaaattttcttcattgatttattatggctaatatttagggcaaagggtgatatactctcgtgagtcagtaactgctaggataacttattcagtcaaaaaattttccctaggcccgtttaccgccactccccctaagttgaattcataatgatgcagtgctttggaaaacagctctgtattaatacaaggtaaaaaagcccccacaaaataaaagcttcttttaattatcctagcatgaaatgaaacaaaaagaaaagtaatagggtagacgctaatttcatctttctttctttgtttctctttgtttctctctttctttgtttctctctctctttctctctctctctctctctttcttgctctgtctctctctgtgtctcttgctctgtctcgctctcttgctctgtctcactgtctctcgctcactgtctgtctcactcttttgctctctctcgctctctcgctctgtctcgctctct

SEQ ID NO: 327513 - DNA, 323 bp, Homo sapiens
ttcagggtatacagcctggggatggaatgtatgtcagtaccattttcattaaaatatacacacatactctctttttcttttttaaatacataaaaattacatacagttgttgcctatggtgggacaagcaagaaatttaacatttttaatctttgtagtaattgcatagtatttaatagattattttatcatgtagtctaggtctctgtgcagccataacctcacagaaaaatgtgctatgatgtagtttaacctgtcttgaaggtgtttgttggagttattttattttatagtgccacagaaatgtgccaaatttcaagaag

SEQ ID NO: 327514 - DNA, 2698 bp, Homo sapiens
catagtatctagattgatcaagatctgacagaaggaatgcacaaaggattctatattcttaatgatttattaattaccaggatccttttctaaattgaatgtacttttgaattactaggtttcttctttttttttgttctgcaatagtgaaagaaaactcagtagtttagtttcagtttctcatggaaattggtaaatgttagttttgacttcatctattttttatttgtttttattagcgtagagtaggaagtctcatattctactgttctatctaggatggtgaaattccaaaggtgcctaacttgagtaagggatttgtgacaagatagtacacattactataagggctattatttcctgaactggatgtccctaaaagcaaataaactgcccactatctctactctagtgctctctttgtccttatcaacatatacctccaataagtaattacataattcaccgttaaacatggacccactctaggtaaaattaccctcatggaaacattttcactgtgagaatgatgaatttaaaaattatgtttgaatcacctaaaatgtatgtgcagcttctagatggccccttagatctgctgggctctagctgtgtactttaaaaaaacaaaaacagctttattgatatataatttacatattatgtaatttacccacttttaagtatctaattcagtgatgttttaatacatatgtagaactatgcagccatcagcacaatctggatttagaacgtttccatcattccaaaagattccttttgtcttttttgcagactcatacctaacacaaatctaaagtttatcactgttgccaggataattacagcaggttatgtttggtttcatttttaagagtggaggtgttcatgattctaagctcaggaatcttgtgatcatgtattaaatatgttatctcatactataatgataaaaaagcttaatgatgtgggttgggatggatattaacataaataattgagtccgctgcttctatagcaatgctgtaggatagaacaataatgtaagtgatatatgtaattaaaaaattctagaagccacattaaaaaataaaaataaacagctgaagttaattttaatattttatttaactcaatacatccaaaatgttatcattttaacatgtaattgatgtaaagatttattctgatagtttgtactatttcttgtactaattttttgaaatctggtatgcattttacaaatttgggcaagccacattttaagtgctcattagccacatgaggccagtggatactgtattgaatagcacagtcctatagcatatttattaatttgtcttgtagtaagatgaaatagacaataatacggaataatatcttaaatggaaatctttgttagtctctagagccttcattgcttgataaataggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactcaaaaaaaaataatgagaatctagtattctgtagttaactaatctataagataaattgctaaagtactagggagcttgtaaatcttaaaaatctttttatttcagtgttcattcaggttggatatatttgaaattgtagatttctatctgtacaacatctcctagttaatagaatttttttccttcccctcccttctctctcctcctccttttctaaccaaagggcattttatcaacaatcatgctgaattcaattaatatctcaagctaaaaaactatgtaattgaggttgtatctggagaagatgggaaaacattgtataatttaagcccttaattgtctgttgagcttttagggctgagtaattgcctttcatacaaataaaagctttaactcttttctcaagagtgtaccaccgtccttagaatcaggtgttttaaatccagtttcttttaattaaatgggactgtagtgatccctaccctgtagagaaatcaacagaactagagaagctaagggcttgatcaggtttcccctagaacctgtgttgcctgcctgctgtatcttccatgtctttcttattcaacttctagaagtagagaaggttgggacttgagtgtagaagaaacatcagaataatttcaaaaaacaggaagttggaactataatttttaaattattgtattgtttttacggattttacatgtatagttaaatattaaaattcatctcttgcagttcaataaaagctatagtatagattttatttttaagaagtttatataattcttttgtgaaccaatatgtaaaactagaatatttattaaactaataatatgtattagtatcaataaaatatgtatttatttttaaattggtatgaaacaaaataaaaatttgtagacactcttaaaaaa

SEQ ID NO: 327515 - DNA, 3122 bp, Homo sapiens
catagtatctagattgatcaagatctgacagaaggaatgcacaaaggattctatattcttaatgatttattaattaccaggatccttttctaaattgaatgtacttttgaattactaggtttcttctttttttttgttctgcaatagtgaaagaaaactcagtagtttagtttcagtttctcatggaaattggtaaatgttagttttgacttcatctattttttatttgtttttattagcgtagagtaggaagtctcatattctactgttctatctaggatggtgaaattccaaaggtgcctaacttgagtaagggatttgtgacaagatagtacacattactataagggctattatttcctgaactggatgtccctaaaagcaaataaactgcccactatctctactctagtgctctctttgtccttatcaacatatacctccaataagtaattacataattcaccgttaaacatggacccactctaggtaaaattaccctcatggaaacattttcactgtgagaatgatgaatttaaaaattatgtttgaatcacctaaaatgtatgtgcagcttctagatggccccttagatctgctgggctctagctgtgtactttaaaaaaacaaaaacagctttattgatatataatttacatattatgtaatttacccacttttaagtatctaattcagtgatgttttaatacatatgtagaactatgcagccatcagcacaatctggatttagaacgtttccatcattccaaaagattccttttgtcttttttgcagactcatacctaacacaaatctaaagtttatcactgttgccaggataattacagcaggttatgtttggtttcatttttaagagtggaggtgttcatgattctaagctcaggaatcttgtgatcatgtattaaatatgttatctcatactataatgataaaaaagcttaatgatgtgggttgggatggatattaacataaataattgagtccgctgcttctatagcaatgctgtaggatagaacaataatgtaagtgatatatgtaattaaaaaattctagaagccacattaaaaaataaaaataaacagctgaagttaattttaatattttatttaactcaatacatccaaaatgttatcattttaacatgtaattgatgtaaagatttattctgatagtttgtactatttcttgtactaattttttgaaatctggtatgcattttacaaatttgggcaagccacattttaagtgctcattagccacatgaggccagtggatactgtattgaatagcacagtcctatagcatatttattaatttgtcttgtagtaagatgaaatagacaataatacggaataatatcttaaatggaaatctttgttagtctctagagccttcattgcttgataaataggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactcaaaaaaaaataatgagaatctagtattctgtagttaactaatctataagataaattgctaaagtactagggagcttgtaaatcttaaaaatctttttatttcagtgttcattcaggttggatatatttgaaattgtagatttctatctgtacaacatctcctagttaatagaatttttttccttcccctcccttctctctcctcctccttttctaaccaaagggcattttatcaacaatcatgctgaattcaattaatatctcaagctaaaaaactatgtaattgaggttgtatctggagaagatgggaaaacattgtataatttaagcccttaattgtctgttgagcttttagggctgagtaattgcctttcatacaaataaaagctttaactcttttctcaagagtgtaccaccgtccttagaatcaggtgttttaaatccagtttcttttaattaaatgggactgtagtgatccctaccctgtagagaaatcaacagaactagagaagctaagggcttgatcaggtttcccctagaacctgtgttgcctgcctgctgtatcttccatgtctttcttattcaacttctagaagtagagaaggttgggacttgagtgtagaagaaacatcagaataatttcaaaaaacaggaagttggaactataatttttaaattattgtattgtttttacggattttacatgtatagttaaatattaaaattcatctcttgcagttcaataaaagctatagtatagattttatttttaagaagtttatataattcttttgtgaaccaatatgtaaaactagaatatttattaaactaataatatgtattagtatcaataaaatatgtatttatttttaaattggtatgaaacaaaataaaaatttgtagacactcttaaaaaaaaaaaaaaaaaaacaaaaaaaaaaacaaaaaacaaaaaaaaaaaaaaaaaaaaaagaaaaaaacaaaaaaaaaaaaaaaaaaaaagaagaagagaagagaagaggcgacaaacgacaactaaaataaaaaaggcaaagagagagcacgaaccgccaggacccgccacaagacaccccagcgcccacagaagaggagagggacagaacagaaaacacgtaacaacacgccaagccgcagacgaccgacatgacaaaaaaaaacggagaagaagcggtggagaaagaacaaaccaagaaatacagcggaggtcaagagaagagaaagaagccactgaaaacagacaagacagagcacacacacagagccacccgacagcgtcaataaaaaataaaagagagccaaaaacaagaaaaacaagaaagc

SEQ ID NO: 327516 - DNA, 2455 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggtaaaaacgtcctactgtatgtgggaatttatttacctgaaataaaattcattagttgttagtgatggagcttatagacgtttctggtttatatagttaagcctgcctgcagtcaggtgtctgagaccccttctcacagcccatgtgtgacagtgtatgggcttttctcacgagcagattagatctgcagctcaagtttttggatcttttttttt

SEQ ID NO: 327517 - DNA, 319 bp, Homo sapiens
ggcaggcgaagcagagaaactctggtggaggtcgtagcggtcctctaaaattgtatcaaatgtgacattatatgcactagcaataaaatgctaattgtttcatggtaaaaacgtcctactgtatgtgggaatttatttacctgaaataaaattcattagttgttagtgatggagcttatagacgtttctggtttatatagttaagcctgcctgcagtcaggtgtctgagaccccttctcacagcccatgtgtgacagtgtatgggcttttctcacgagcagattagatctgcagctcaagtttttggatcttttttttt

SEQ ID NO: 327518 - DNA, 281 bp, Homo sapiens
ccattttcacattatctgggagatgcaattgaaacaatacaaaatacagtattcatcacatttaacactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327519 - DNA, 3929 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327520 - DNA, 3878 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaagtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327521 - DNA, 3134 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327522 - DNA, 3875 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327523 - DNA, 3637 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327524 - DNA, 3235 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaacagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327525 - DNA, 3875 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttcattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327526 - DNA, 3870 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327527 - DNA, 3519 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtaaaaaaaaaaaa

SEQ ID NO: 327528 - DNA, 2266 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgatctgggatcgggcctgaggtttgccagcatttagaccctgcatttatagcatacggtatgatattgcagcttatattcatccatgccctgtacctgtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggtaaaaacgtcctactgtatgtgggaatttatttacctgaaataaaattcattagttgttagtgatggagcttatagacgtttctggtttatatagttaagcctgcctgcagtcaggtgtctgagaccccttctcacagcccatgtgtgacagtgtatgggcttttctcacgagcagattagatctgcagctcaagtttttggatcttttttttt

SEQ ID NO: 327529 - DNA, 2398 bp, Homo sapiens
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaaaagatatcccagaagaaactgaagaaacaaaaacttatggcacgggagtaaattcagcattaaaataaatgtaattaaaagga

SEQ ID NO: 327530 - DNA, 352 bp, Homo sapiens
gaactccaaatatatgttgactaaccacgcacaagcagatttaattctggccctaagatcatttaaaaaaataataaaacccagttttccagagtgtatttctctcttttggaaaagtttctgctccacatctggaagtgattttctaacaacactaattccaatgagtcatctatgatattaagcaatgattccatagggtgaaccctgatcatatttttccattgactggcagccaccgaggtcaatgaaaggcaaaggcgaacccagacatggagaacctcaccctccacagctccatcttgtattatcaaggacatgggttttaagaagtacaggaatgcaatccatc

SEQ ID NO: 327531 - DNA, 1254 bp, Homo sapiens
gggggtggggtccccggggcggggcggggcgcgctgtgtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 327532 - DNA, 1413 bp, Homo sapiens
gggggtggggtccccggggcggggcggggcgcgctgtgtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaaacaacaaccaaaaggggggggctaaattccccagggccattaccgcaccgtttttgcacgggcccaaggaaggataaaaggcaggggtaaccggcggaacggtgggttgggggccttcggggaggcccccaaccggaaggattgctcgggggtaaaacg

SEQ ID NO: 327533 - DNA, 1263 bp, Homo sapiens
aagactggaacccgtatgagcgccccccagcgcccctgagcgctcgccgccggtgcacggcgcaccccgcgggaggcagggatcagcaaagccgtgcgccccgaggcccgcccccgtctccgcacaaagaccgagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 327534 - DNA, 1507 bp, Homo sapiens
gggggtggggtccccggggcggggcggggcgcgctgtgtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaggcagaggttgcggtgagccgagatcacgccattgcactccagcctgggcagcaaagtgaaactccatctcaaaaaaaaaaaaaaaaagaagcttggcaccagcatctccttctgatgaggccctcaggaagcttccactcatggtggaaggcaaaggggagccacgtgtacagatcacattgcaagagaagaagtgaaagagagagagagcgagcaggtgccaggatcttctaaacaaccagctttttcagaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 327535 - DNA, 984 bp, Homo sapiens
atttgatcatctgaggcgtatgaacggtctactccgagtgcggaccgctgatgcgccgttgaaggcttgcaggtcgtctggaggtagctctgactaggagaagaccgtgccacaccaggacattggcatcatcgctggagctggtggaagggaggctggtggaagggagctggtggaagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 327536 - DNA, 556 bp, Homo sapiens
aagactggaacccgtatgagcgccccccagcgcccctgagcgctcgccgccggtgcacggcgcaccccgcgggaggcagggatcagcaaagccgtgcgccccgaggcccgcccccgtctccgcacaaagaccgagctggaggatcttcagaagaagcctcccccatacctgcggaacctgtccagcgatgatgccaatgtcctggtgtggcacgctctcctcctacccggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 327537 - DNA, 645 bp, Homo sapiens
gggggtggggtccccggggcggggcggggcgcgctgtgtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgtgagtatccatggggaccatggctttggattggggccaaattaggccagggacatgggcagggagggttaggactaggcaagaattttccctgcttgagatccttttactggaggttatcattgctggagggggcttctctctgaattgattgcttctgagatccagatacttctgaggttcaccttctgataaagatgccaaaggacttttgacttagtaggagaccccttccttaaaccagtagccaccaagcccaccacagaacttcaggagacaaacagcatcaaaaagaagaagaaataaagatttcttggacctttgtcaaggggtagggataaacttccaggctctcacagttgggagaatttgctcccgcaaacctaaattgtattttgtttttctgtagtcttatttcagaaaatt

SEQ ID NO: 327538 - DNA, 271 bp, Homo sapiens
cactaatccatgactcaattgtcaaatgaatgcaggtgctgtgtgtgtcctggctcatgattcctcctgggagtgaagcagaggatgcctaggaccctcggattggggcaggaagggaggaaaaccagactggagcttgaccccttttctctctgcacaggaccaacctccctaccacctgaaagccttcaacctgcgcatcagcttcccgccggagtatccgttcaagcctcccatgatcaaattcacaaccaagatctaccaccccaac

SEQ ID NO: 327539 - DNA, 305 bp, Homo sapiens
agcgggagaaacgttgcagcccgcgccgaacgccgggcagcacaaaggatccccgactgccggggagcggtgctcggagggcacaggtctacgccatcccccacgcagtttcggagatggagcgctgggcccatggagggaaggcggcaggctcggcggctccggcagcttgctggggcaggggctcaaggcggcagtccgatagtggaggccgctgagaactgtcacggagctgcgtctgtacagcgagcatcccttatttattcagggcgagtgtgtatttggggcggcgtgcagggggctga

SEQ ID NO: 327540 - DNA, 1414 bp, Homo sapiens
tcctgcctgaaacttgtgataacaactgggtgcatctccagtgcaggaaaagtccttggcatcttggtgccaggcattctgctactgctggtggtgggttatgaacacagatgaccaggatgaagtccttgccttggaataagcccatagcccatcccataatttgatgcctgtattactagagtcctgagaaacacggaatgctgattagaatttgggacaaagttccctgagtattctctggaggaaaagatgcggaggtggacctggaaggcctcctggagagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 327541 - DNA, 1237 bp, Homo sapiens
agcgggagaaacgttgcagcccgcgccgaacgccgggcagcacaaaggatccccgactgccggggagcggtgctcggagggcacaggtctacgccatcccccacgcagtttcggagatggagcgctgggcccatggagggaaggcggcaggctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 327542 - DNA, 637 bp, Homo sapiens
gggggtggggtccccggggcggggcggggcgcgctgtgtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgactttaatggcttaagcaagaacatggtttccgtggctccccctggactgaatgctggaggatatatacttcacagtctgaggcctggtcccaggaactggcaatctaacaggatggcaagtggttttgaaacatatagattttcaggatggaagtttgatt

SEQ ID NO: 327543 - DNA, 812 bp, Homo sapiens
aaatatcagaacaatagtttttgatcttgatggaattcaacagagatattcttagtaaatgttcagaggtaaagaaagaatttaatatgaaccatttttggaaaacaacgtccaggtacgtatatgtatataaaccagaaggaaatgaaccaaaatgttaataagggttatttttggcagttttatggtattgtaaactattttaatcttgtttttttttatatgaattatgtgatcagaaaaaaatattaatatttagttaagaggaaagcaaataaattgtgccttggtatttcacatctctgaataaaaatagtctctcaaacctgaacaaatactgtcttggttatcaagaataataatcatttatttttcttttttcccagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggtatacatatttaaacattcaataaaatgaagactctttttcataggaatttgtctgcagatttgttatgaaaaatctaatgatcttttatttctgaagcatgctgtaaaagataggat

SEQ ID NO: 327544 - DNA, 5354 bp, Homo sapiens
aaaaaaaaaaaaaaaaaaaaaaaaaaaaaaagttcctgggagaagccgggctgcctcacgaggcactaggaactacatttcccggaaagtactaaatttaagaatgtttggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcaggcattcaacaacatgttttgctgtaccttgcagtgttccgagttctacctttttcacttgtagggattctagagatcaacaaaaagatttttgggaacgttacagatgctaccttgtctcatggaatactgattgtgatgtacagctcaggactggtcagactctatagcttccaaaccatcgctgaacagacatgccaccactgctctttgaggtgtcatccctggagaatgcttttcagattggaggccatccttggcactacatcgtcacacctaataagaagaaacagaaaggagttttccatatttgtgccctaaaagacaattccctggcaaaaaatgggatccaggaaatggattgttgttctctagaatctgactggatctatttccatcctgatgcttctggtagaataatacatgttggtccaaatcaagtcaaagttttgaagctaactgaaatagaaaataatagttctcagcatcagatctctgaagattttgtcattttggccaacagggagaaccataaaaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagctgcgtccaatccattttattatctgcatggcacattctccagtattttccaaaaaagtcttgtgttgacttcagatgactatgacttcttttttaaactcttgctgtaaaagatggtgaggacttcattttttttaaaggttttttagaatactgttccaagaagtttagtgttttgcagctttgagctaggtggtaatgcaaatataaaatgctgggaacagaaaaggacaggttaattccaattgttgaggagttaagtcattgatggggtgggtcattgatgagttcttaaaggatggtatggaattttgtttgttaaggctaggaaagacagggagagacaaaagtaaacatgcagaaagaaatcttatatcctctataccaaactttgcttaaggatgagaaatgagatgtgttatgtgagaacattattttgagcccaaaatgtgtcatcacagtttttaaaaatcttatatatgtatttatatgtgtttcgtatttgtatatagtatcaagaattggttctagttcccaaattatcttttcttccttggttttgttctcttggcttgatgttcacattgaatatttgtgtttctatataggctaatgtaaaagatgccaagcaaaccttaagtgaaattgttttctgatttgcatcctgtttagctcttaatgtatctaaggatgttctcatctcaccattctactcatttagtgagttttctgatcttgtttaggcaatatttgcatacttatgcaataagataaaggtacccttgcctgcagtagttctgtttcctgtagaaaagtggataaagagtcccagaagaagttcttactagcttgggagttacctgattaaccagagaaaatttttggcttacttatggaacaagcattatttcttctttgttaggaaagatctaaatatggtccttgacttttaataatcattctttagaatgttaaataaaggcaacccaagtaaagggagaaaatgtttctttgtgcttcctgtttgagaaattcagttgcttccatttcgcatgttctgcacatttatccgatgtaacctcaaaagaataactggtaataagggaaggaaacagcagcaacaatcattgctgattcaagtttaaggttaaaatatggaatttttagcttggatgatttatattaaaatctttccattttttttttcagttttggcttgatgccatgttaagaatgatgtgaattcttcccagttctgccctggtgctagacattgccccatactttcaattagacactagctgtatctaaatagtcccactcagtaaacttacatcttgaaaaacaagaccagtaagaggccagtgaaagtactaaagaaagaaaccaatgttgtgtgagtttcaaagcagctgcaatgctgtgtaaaagtagagtgttcattctccatttccaagagtgtttcagaataggatgtcttaagacttcagtcatgtcagagatttttttttttaggtgattattgagtttctccttctcctttaagtcatcaccttccttttatgaaatgatagtaaggaactcgtctattctgaaaggcatttgagaaatagctgaattcctggctgcttttttgctgggggtagatggtggaatacttctggtctagatataacttaccactaagaaacccccagtatgtcaccactgcctaaatctaactagaccagggtccaaatgccatccaggccaggcaggaaatatacctcatgtgaaagacagtaaggagttgtgggcagtgtaacaaacaggagagctatgccccaactaaaaggagcagctgctactgcttagtttcagccagttgcaacagtatgtgggaatgtaggctgcatggttgttaacaagatagatggtaaaaagatgccagaagatacagaagatagcaaagaatgtggggaatttggataccacacatagcgagagacaatgaagcatgcttcccagctcgccagagtgtcacacagctgctcattctgccacctgccagacattaatgtcttcctgccctacctaaaccccctctttacctgatattttaattcgagactctagctacatgcccacctacttaacaggtactagtgacaggtacaaaacattatgggtaacaattctgagtgtttaatgcaagcccaggtgaagcagggtagcttccatcagcaggtacagacgttacgctgaaaagaggtgcattctgcattgcactcctggatctaagtttctgtattctcagagcatcaatgcagcaagcttattgttcctcaattttttacaatatttatcacaactctgggagaaaacaaaacaaatcctatcctatttactatttgtgctacctagtgaggagataccgctctgtttagacaaattaaggcacttcacattcttccaccaattgaaagttttgtatcttacagttctttttttaaataatatatttattgagcactttctatctactagtcactgtgatacagtataagtaaagtgggttgtctcatttaatattcagaataaccacatgaagtatgaactgccattatctttcccctttgtacaaatgaggaaagtgaggctcacagaagttaattggcccagggtcccacaactagtcagtgcagaggtgggaaacataaccagatttgttcggcatgaacttgtgccaaatttcctccaaagttctcaaaaggcaaggcatgttattttatcccaatttagcataccaacaactataatactagatatgtaggaaagtgcttaataatcgttttttactgatgattcagtgtctaaattttgaacaaatttgggtaagatacaagtcacacataaattgacagaaaatgtagttcttcattcaatggttagcagtcattaaaaggtactttccctttgtttgtggtgataatcagtattagtagttttcatattatttggcttccatattaatcatttttatattttcttctccttcttaccatgtttacttatatcatccatcttttagaatcccagggagctaatttctggtccctgtgttgctatcaaatctgtatcttgcagaaagaataatttatttcaaacaagggacatacaatagaaagataagacctactgaggtctttttcccatcattttattatgaaaaatgttcaaacatacagtaaaattgaaagaattttatagtaaatactgaccacggggattctacatcttactctacttgttttattattttcctatccagcgtactttttgatggatttcaaaataaattgcagttgctgatatacttccccctagtacttcaactgcagattattaactagagtttagtatttatttagtttttaaatttttttgatttaagatttacctgcaataaaatgtacaaatcttaagtataaatttactgagttcttgcagacatatacacctgtgtaacccaaaccctttccaaaatttagaccattgcaatcatcttcagaaagtttcctaaatccctctcccagtctatcccctccccacccctcaggtataactactgttctcattcttttatatcaaaggttaaatttacctgttctaaacttcatatgagtgaaattatacaaaatgtaatgcttctttcacttagcataatgtttttgagatttattcatgttgttgcatgtgtcagtgattcatttctttttattgctgagtattctttcgtatgaatatatcacagtttgtttttttatctttctgttgatggacactgggctctttctgcttgttttttactgttatgaataaagctgctatgaacattcttagacaaa

SEQ ID NO: 327545 - DNA, 5310 bp, Homo sapiens
gaggaccaacctgggcatcctgcgggcgctggtgtgccaggaaagtactaaatttaagaatgtttggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcaggcattcaacaacatgttttgctgtaccttgcagtgttccgagttctacctttttcacttgtagggattctagagatcaacaaaaagatttttgggaacgttacagatgctaccttgtctcatggaatactgattgtgatgtacagctcaggactggtcagactctatagcttccaaaccatcgctgaacagacatgccaccactgctctttgaggtgtcatccctggagaatgcttttcagattggaggccatccttggcactacatcgtcacacctaataagaagaaacagaaaggagttttccatatttgtgccctaaaagacaattccctggcaaaaaatgggatccaggaaatggattgttgttctctagaatctgactggatctatttccatcctgatgcttctggtagaataatacatgttggtccaaatcaagtcaaagttttgaagctaactgaaatagaaaataatagttctcagcatcagatctctgaagattttgtcattttggccaacagggagaaccataaaaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagctgcgtccaatccattttattatctgcatggcacattctccagtattttccaaaaaagtcttgtgttgacttcagatgactatgacttcttttttaaactcttgctgtaaaagatggtgaggacttcattttttttaaaggttttttagaatactgttccaagaagtttagtgttttgcagctttgagctaggtggtaatgcaaatataaaatgctgggaacagaaaaggacaggttaattccaattgttgaggagttaagtcattgatggggtgggtcattgatgagttcttaaaggatggtatggaattttgtttgttaaggctaggaaagacagggagagacaaaagtaaacatgcagaaagaaatcttatatcctctataccaaactttgcttaaggatgagaaatgagatgtgttatgtgagaacattattttgagcccaaaatgtgtcatcacagtttttaaaaatcttatatatgtatttatatgtgtttcgtatttgtatatagtatcaagaattggttctagttcccaaattatcttttcttccttggttttgttctcttggcttgatgttcacattgaatatttgtgtttctatataggctaatgtaaaagatgccaagcaaaccttaagtgaaattgttttctgatttgcatcctgtttagctcttaatgtatctaaggatgttctcatctcaccattctactcatttagtgagttttctgatcttgtttaggcaatatttgcatacttatgcaataagataaaggtacccttgcctgcagtagttctgtttcctgtagaaaagtggataaagagtcccagaagaagttcttactagcttgggagttacctgattaaccagagaaaatttttggcttacttatggaacaagcattatttcttctttgttaggaaagatctaaatatggtccttgacttttaataatcattctttagaatgttaaataaaggcaacccaagtaaagggagaaaatgtttctttgtgcttcctgtttgagaaattcagttgcttccatttcgcatgttctgcacatttatccgatgtaacctcaaaagaataactggtaataagggaaggaaacagcagcaacaatcattgctgattcaagtttaaggttaaaatatggaatttttagcttggatgatttatattaaaatctttccattttttttttcagttttggcttgatgccatgttaagaatgatgtgaattcttcccagttctgccctggtgctagacattgccccatactttcaattagacactagctgtatctaaatagtcccactcagtaaacttacatcttgaaaaacaagaccagtaagaggccagtgaaagtactaaagaaagaaaccaatgttgtgtgagtttcaaagcagctgcaatgctgtgtaaaagtagagtgttcattctccatttccaagagtgtttcagaataggatgtcttaagacttcagtcatgtcagagatttttttttttaggtgattattgagtttctccttctcctttaagtcatcaccttccttttatgaaatgatagtaaggaactcgtctattctgaaaggcatttgagaaatagctgaattcctggctgcttttttgctgggggtagatggtggaatacttctggtctagatataacttaccactaagaaacccccagtatgtcaccactgcctaaatctaactagaccagggtccaaatgccatccaggccaggcaggaaatatacctcatgtgaaagacagtaaggagttgtgggcagtgtaacaaacaggagagctatgccccaactaaaaggagcagctgctactgcttagtttcagccagttgcaacagtatgtgggaatgtaggctgcatggttgttaacaagatagatggtaaaaagatgccagaagatacagaagatagcaaagaatgtggggaatttggataccacacatagcgagagacaatgaagcatgcttcccagctcgccagagtgtcacacagctgctcattctgccacctgccagacattaatgtcttcctgccctacctaaaccccctctttacctgatattttaattcgagactctagctacatgcccacctacttaacaggtactagtgacaggtacaaaacattatgggtaacaattctgagtgtttaatgcaagcccaggtgaagcagggtagcttccatcagcaggtacagacgttacgctgaaaagaggtgcattctgcattgcactcctggatctaagtttctgtattctcagagcatcaatgcagcaagcttattgttcctcaattttttacaatatttatcacaactctgggagaaaacaaaacaaatcctatcctatttactatttgtgctacctagtgaggagataccgctctgtttagacaaattaaggcacttcacattcttccaccaattgaaagttttgtatcttacagttctttttttaaataatatatttattgagcactttctatctactagtcactgtgatacagtataagtaaagtgggttgtctcatttaatattcagaataaccacatgaagtatgaactgccattatctttcccctttgtacaaatgaggaaagtgaggctcacagaagttaattggcccagggtcccacaactagtcagtgcagaggtgggaaacataaccagatttgttcggcatgaacttgtgccaaatttcctccaaagttctcaaaaggcaaggcatgttattttatcccaatttagcataccaacaactataatactagatatgtaggaaagtgcttaataatcgttttttactgatgattcagtgtctaaattttgaacaaatttgggtaagatacaagtcacacataaattgacagaaaatgtagttcttcattcaatggttagcagtcattaaaaggtactttccctttgtttgtggtgataatcagtattagtagttttcatattatttggcttccatattaatcatttttatattttcttctccttcttaccatgtttacttatatcatccatcttttagaatcccagggagctaatttctggtccctgtgttgctatcaaatctgtatcttgcagaaagaataatttatttcaaacaagggacatacaatagaaagataagacctactgaggtctttttcccatcattttattatgaaaaatgttcaaacatacagtaaaattgaaagaattttatagtaaatactgaccacggggattctacatcttactctacttgttttattattttcctatccagcgtactttttgatggatttcaaaataaattgcagttgctgatatacttccccctagtacttcaactgcagattattaactagagtttagtatttatttagtttttaaatttttttgatttaagatttacctgcaataaaatgtacaaatcttaagtataaatttactgagttcttgcagacatatacacctgtgtaacccaaaccctttccaaaatttagaccattgcaatcatcttcagaaagtttcctaaatccctctcccagtctatcccctccccacccctcaggtataactactgttctcattcttttatatcaaaggttaaatttacctgttctaaacttcatatgagtgaaattatacaaaatgtaatgcttctttcacttagcataatgtttttgagatttattcatgttgttgcatgtgtcagtgattcatttctttttattgctgagtattctttcgtatgaatatatcacagtttgtttttttatctttctgttgatggacactgggctctttctgcttgttttttactgttatgaataaagctgctatgaacattcttagacaaa

SEQ ID NO: 327546 - DNA, 978 bp, Homo sapiens
gcggccgagcctcctgcggggatgcggttttaacgcgctggggcctccctttatagggtcacatgtgatggggaggaggatacaagcccggaatctgggataggtggtaatagggccaccagctgcttttagttttacgcttcttatgtcttacctggaaacaattattctaaaagttggtcacctcattaagccaaaacatgagggcagagtggaggaaggatgcaaaaagttttaaaataatataggaaagtactaaatttaagaatgtttggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcagaggcattcatcaacctggtttggtggaccttgcagggtccgaaggtactaacgtttctcaccctgtgtacgggaattcctaggaaaatcgaggaaagagcatttttaggggcaacagctcgaggaaggcataccgatggccccacggggacaacccggccggcgaaagaccacggcagagcaaggggcaaaaccataatagagacaaaacaatgagggaacaacgacgggccccagggcacagttagagcgcacacccgggagacacagtagtcagcaaggcacgacaccgtgggcaaagaacgacacacaagtg

SEQ ID NO: 327547 - DNA, 1472 bp, Homo sapiens
ggctgcagacgccctggtcggagcgtctggggccagatgttatagggcaagctaaaaataaccgggcaggccagccaccatcgaggaaggggcatgtgctggacgcggacacatgatccgagggaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccagtcttagactggctggtgcagccgaaacctcgatggcttggtggcaatggctggctcctggatggccctgaggaggtgttacaagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcagatgggcgaatcctacgacacaaactttacaaagaatatccagaaggtgactcaaagaatgtggcagaacctggaaggggacaacagaagcactttcagtaaagcaacggcaagcagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccgcccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataaaaaaccgagtctctggtgttttgt

SEQ ID NO: 327548 - DNA, 960 bp, Homo sapiens
agaggctgcagccacccagccccgaagcagggcccagcgagacagggcccagtggggccttattctctctcttgcagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccaccatctgcctggtgtcagaggggcttgggcagcccttgggagtggcctgtgcaccccagggccagctcctggtggctgatgccaaggacaa

SEQ ID NO: 327549 - DNA, 935 bp, Homo sapiens
agaggctgcagccacccagccccgaagcagggcccagcgagacagggcccagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccaccatctgcctggtgtcagaggggcttgggcagcccttgggagtggcctgtgcaccccagggccagctcctggtggctgatgccaaggacaa

SEQ ID NO: 327550 - DNA, 1181 bp, Homo sapiens
aagtccctcagtcccccaggagcctccttcatggacccggggatcccaagaggggctgcctcaacttaggatgggcaactgtgtcaagtatccactgagaaatctctcaaggaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaca

SEQ ID NO: 327551 - DNA, 1856 bp, Homo sapiens
gggtgggtgcctgtagaccaagctgctcaggaggctgaggcaggagaatcacttgaatccgggagtcagaggttgcagtgagccaagatcacgccactgcactccagcctgggcgacagagtgcactagccacacacaaaaaaggagggggcatgtttccactttgccccagtccccacctctcacaccctgcctgcttcgtttatgtcagcaatggcacctgcatgtgcaacctctggtctggcagaccagccaagcctggtctccatgctgccagctccgattgccctcactgccttccagcggggatctggctggggtaggacaagtctgtttgggagctgggaggaatgacttagccctggagattgactgaattgggaggttgggagcatttcgggaaaggatgttgtctcattaggctctgagtgaacacttcccattggtgagaatagaagccccccgctgcccctgtctcttcatgcacttgggtgtgtgattctgtgcatatgtatgtgccagtgcgtgcgtgtgtgtgtgtgtgtgtgcgcatgtgccacacagagggcatcacattcagctctccccggaaccaccatttccgtcaaggattggagactctgtctgttggaccaatttgatgcctgtgcacgctcagggctctctgaaccccgctccttgactctcagggtcccctcttgcggaaagcccctcccgggaccaggagccaggctgggcagggaggtgacaccctggctctcttttgcatttgcttggtgctggtctgaaaatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaca

SEQ ID NO: 327552 - DNA, 734 bp, Homo sapiens
ggcgctgcaggttagagcctggcaatgccgtttgggtgtgtgactctgggcgacaagaagaactataaccagccatcggaggtgactgacagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaca

SEQ ID NO: 327553 - DNA, 806 bp, Homo sapiens
gtgttccatgtttcttcgtgtgtcatcacccttcatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaca

SEQ ID NO: 327554 - DNA, 223 bp, Homo sapiens
ggtgactctacaggatcttaccgactagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaca

SEQ ID NO: 327555 - DNA, 386 bp, Homo sapiens
cctgctgccacgtggatggcccccaggttagatattttgtgacttccaggtcccttgtcgcggctaataggacatgttcttttgtttcaggatagatcactgcgaccagaggaaattgaaggtaaaacttggccccttgggggaaaggactgcctagccctctaggaaggtgtgggaagggaggttgatgggaagagaggcccctggaaatggggcctggtgcaacgcggggtatcttctgtgaaaccagctgctgaaggtgtgcacaggaggcaagagaaatgccccagcatcctgggaagctcctgggcctctctttccatgccggtgggcctttgggctgcctttgcccacagaggctctgcgggtcctacccctgaccacat

SEQ ID NO: 327556 - DNA, 1001 bp, Homo sapiens
aagtccctcagtcccccaggagcctccttcatggacccggggatcccaagaggggctgcctcaacttaggatgggcaactgtgtcaagtatccactgagaaatctctcaaggaaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaca

SEQ ID NO: 327557 - DNA, 1220 bp, Homo sapiens
agcggagcgcgtcctcgggcttggctcccgccgggagccccgttctctgcccgccgggggccccgcgccgcgccgcaccgcgccgcccccgccgggccatgcgagcgcgggccccgccgcgatgagctcgcacatcgccaaaagcgagtccaagtcgtcgccgctgccgccggcccgcgggcgggatggggaggaacggggactgtccccggcgctcggcctccggggctctctgcgagcccggggccgcggggactccgttccagccgccgcgtccgaggcggacccgttcctccaccggctgcgccccatgctcagctccgcctttggccaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaca

SEQ ID NO: 327558 - DNA, 1293 bp, Homo sapiens
tgttctctgactcattctttttttgttttttttttttgagacaggtctcactctgttgtccaggttgacagagtgcaatggcaccatcatagctccttacagcctcaaactcctgctgacccattcttgtatctggaacaaggggctggaggcacagaggttctgtgcccaggctggtggggctggtggcttcttgggcatctcctgttaggggcccaggagcttctatgtctaagggagatgtggggctttcttctcccctcaaggacctgatccaggcacacctgtgctgcatcctcgtcacctcctacccagtgcctgctgccacgtggatggcccccaggttagatattttgtgacttccaggtcccttgtcgcggctaataggacatgttcttttgtttcaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaaaca

SEQ ID NO: 327559 - DNA, 3301 bp, Homo sapiens
ttctattccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtctaaaaaaaaaaaataatgtgaacaaacagataaataacaaccgtaccacagtacaacatcctcggcgccgctcattcgcgcgggcgagaacaggcaggctcttagacgggcgccgtggactatcatttctctgcccccttttttttcaccatgtgtaaaccccgcgcgccccaatagggccgaaattcagaagcgggtcccgta

SEQ ID NO: 327560 - DNA, 3295 bp, Homo sapiens
ttctattccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtctacttcttggtcttcacttgattccacgtcctgagggcccagaaagagtcccctgcttgcagccttccgtctctccctggactctccccaagtccaggtcttgtctcattcctccccctgtgtagggagcctcatgccccagcagagggagctctgagattagaaaatcagtcctccctatagccaccccaaagtatg

SEQ ID NO: 327561 - DNA, 2499 bp, Homo sapiens
ggaaggcggttctgagagcttcagagagcgatggaaagcaaaatgtgtgaattgcctttagacatcaacatccccctgatgagcgcagagagagctgcaggtgggcatcccggtggctgacgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagtcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 327562 - DNA, 1289 bp, Homo sapiens
cgtaaaattctagatggcagaagcaggaagaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 327563 - DNA, 1027 bp, Homo sapiens
ctgtatatcgtgtctagctgccctgaggatgctagttacaccctctctgatacctgtggacgtttaagcaccagcctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 327564 - DNA, 2247 bp, Homo sapiens
ttctattccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaaggtaggcgactgtacctctcttgtcctggaatgggcgatggctgggagaagtgaccaggccccaactctctctccagcctcgcctgattctctaagacttgccagcccttctcctgacccctgcaccgcctcctccaccttcgttcattcagcaagaatgaactgggctggggtgaaggaactctgcaggggcaggaggagaggacaaaggaaggaaaccaacttcatcagtgttactccagtggcttctgacacacagaaggggactgtcatagtcatgcttgatctcatgctcattcttttaccccctagtgcctccatactgagaggtacacacgggtgaacacgcacacacagacatgaacaggacacgaaagcaaagcacaggaacaagctctggctcattcacagaatcatttattcacaaatgtattgagtgccatgcaccaggcatgttttagggctgaggagatggcactgaacacaatggttatggcccctgtcctcatgaagtttatagtctgatgcagaaaccaataaacaaggaggcacccaataaatacattcttagaaagtgtaatatgtgctttgtaggaaagcaatgggggtagtgtaattgagattcatgggggagagctgtttagataggatgatcagagaaggggtctttaatgccgcaaaggatgaggagagagccaaataacgcagagaagagtgtttggggtacagaaaacagtcagtgcaagggcactgcagtaggaggggcttgcacatttgaggaacaggttggtggtccctgtggccagagcaaattgagaagagtgccgaggaagagatgtgcttggaaagggtcagattcatgccactgggatgggaagagggtaagtggaggttcacaggaggtttcctgaagaaatcagctcctggaggaagtgagggaagaaaaaaaagggccagggagtgccatggcaaccaattctgagaggtgagaggtcatggg

SEQ ID NO: 327565 - DNA, 1017 bp, Homo sapiens
ttctattccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcatggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 327566 - DNA, 3099 bp, Homo sapiens
ttctattccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 327567 - DNA, 3155 bp, Homo sapiens
ttctattccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagagtccctcaccagcccatggcccttagggccactgaacaacacccttcctccccagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 327568 - DNA, 3068 bp, Homo sapiens
ttctattccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 327569 - DNA, 2171 bp, Homo sapiens
ttctattccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcctcgcctgattctctaagacttgccagcccttctcctgacccctgcaccgcctcctccaccttcgttcattcagcaagaatgaactgggctggggtgaaggaactctgcaggggcaggaggagaggacaaaggaaggaaaccaacttcatcagtgttactccagtggcttctgacacacagaaggggactgtcatagtcatgcttgatctcatgctcattcttttaccccctagtgcctccatactgagaggtacacacgggtgaacacgcacacacagacatgaacaggacacgaaagcaaagcacaggaacaagctctggctcattcacagaatcatttattcacaaatgtattgagtgccatgcaccaggcatgttttagggctgaggagatggcactgaacacaatggttatggcccctgtcctcatgaagtttatagtctgatgcagaaaccaataaacaaggaggcacccaataaatacattcttagaaagtgtaatatgtgctttgtaggaaagcaatgggggtagtgtaattgagattcatgggggagagctgtttagataggatgatcagagaaggggtctttaatgccgcaaaggatgaggagagagccaaataacgcagagaagagtgtttggggtacagaaaacagtcagtgcaagggcactgcagtaggaggggcttgcacatttgaggaacaggttggtggtccctgtggccagagcaaattgagaagagtgccgaggaagagatgtgcttggaaagggtcagattcatgccactgggatgggaagagggtaagtggaggttcacaggaggtttcctgaagaaatcagctcctggaggaagtgagggaagaaaaaaaagggccagggagtgccatggcaaccaattctgagaggtgagaggtcatggg

SEQ ID NO: 327570 - DNA, 387 bp, Homo sapiens
cctagtgagggggttccagtcttcatctataagaggaaaccatggaaatgtaccttttggtgccatccaggagattcatgcccatttaattcctgattctgccacttactggttgtggggctctctttcctcagaacctgatgtccaggttgggtttactattcctaaaaggtcctttcagcttttatcaatctccacccctagggcctatctccaaggatggggtggggtgcagggagggaacaccctaaggccaaagctttacaaacctttccaacacttgtctcccccagcctggtatttgcaacccccctgtgctgtgccctattcccccagaagaggtaagtgctgtccctgggctgggtgggggactctggattggactct

SEQ ID NO: 327571 - DNA, 427 bp, Homo sapiens
aagcgcagccaggcaggcaaggagggcttcctggaggaggactggcttcctgggctcaggaaaaacatccacattcactccgagtctgaggcttccaggtcaccccagtccccgcactgctgcaccagcggtccccctgtgcccctctctgttgtgtggctctgccccacccttcctccccgtcctgtgctggctcccaccctctgggctctctgccctcgtccacacctcggcggcaggagtcactgagtcagagatgcgaatccacccgagtggctccctacatacacctgcctagctccaggcccttcaacgcctccgggccattcaacgcctccgggccattcaacgcctccgggccattcaacgcctccgggccattcaacgcctccggccattcaacgcctccggccattcaacgcctccg

SEQ ID NO: 327572 - DNA, 172 bp, Homo sapiens
ctgggacgacagcagctccgtcagcagcggcatcagcgacaccatagacaacctcagcactgatgacatcaacaccagctcctccatcagctcttatgccaacacacctgcctcctctcgaaaaaacctggatgtgcaggtgaggaacacaggccctcccaggctcctccag

SEQ ID NO: 327573 - DNA, 369 bp, Homo sapiens
ccaaattgctggaattacgggcatgagccaccatgcctggccaaacaaaggcaattctatgccaggtcggtcttgttcccttatctcagtgagctggaggtttgtacaagtttttatccaaatgtgccagaggtttttctgtctgtgcagccatgggcaggtctccaagcacaacaccatgtgctagttaccttgttagtgtctgcagcttgattttttccaggattccttttatgttatgcagggatgagatactgacccaagggccagggactttccagggacccttctcttgctatctaactaaagcaagctaactaacttgtttcagaattaatgagtattcacttttaattttgtaagacaaaa

SEQ ID NO: 327574 - DNA, 222 bp, Homo sapiens
aaggctcccctggggtgggatagaagaaaagggacaacaggatgggatagagtagaatgacaaccagccatcagtaagcctggctcacacagattgtatttttataccaacatagtgacctgaaagataatggcttctgtgtgaggaagtatcctttgattttatgtgcggatatgaaacagagactaggaagttattcaggaaaacacacacacacacaca

SEQ ID NO: 327575 - DNA, 210 bp, Homo sapiens
ggcatatttggctttattgaattctacaaagtcaaatagaattgtattggaattattttacatgcaacattggtattagtgtggctgatcaaagaattgattgtacttaaatatgcaaatagtattaggataatacaatactgcaatttgatgtcctcttcaaaatagctctgaaaaatatgattggaatttctggagtctattttgaaa

SEQ ID NO: 327576 - DNA, 555 bp, Homo sapiens
tacaggggtgagctacagttcccggcccaagagttggttttgaggcagaaattaaccagcctcaatggatatgaggagtgagggagaaaggttccagggtgtctgcattttttcacttggtcaactgggtgaatgatgaacttaagtaagaaacataagaggagaagcagagtttgggttgtggatgagaatatcaaaggtacctgtagaacagagatcatgacataatatagccttacaaaatgtttcttcttctgccattaaaaataacatatgggggccaggtgtggtggctcgtgcctgtaatcccaacattttgggaggctgaggcaggaggattgcatgaggccaggagttggagaccagccttggcaacatggtgagacctatctctacaaaaaaaaaaaagctgagtagtgtggtgctgctcacttgtgatcccagctgctcgggaggctgaggcaggaggatcacttgagtctagcagtttgaagttttagtgagctgtcatcacatcattgcactccaacctgggtgacagagcaagactccgtc

SEQ ID NO: 327577 - DNA, 432 bp, Homo sapiens
tttttggacatggagcccactgactccaggaagagtccattttccctggaagagtaacccagcaagatcatggcaggtattgacataacattgtttaaataggacgtgcaaaggtggttagtgtgctggaaatcttgataagaaaatgagaggccaggtgcggtggctcacgcctctaatcccagcactttgggaagctgaggcgtgcagatcacgacgtcaagagattgagaccatcctggctaacacagtgaaaccccgtctctaataaaaatacaaaaaatcagctgggcatggtggcatgcgcctgtagtcccagctactccggaggctgaggcagcagaatcacttgaacctgggaggcagaggctgcagtgagccgagatcgcgccactgcactccagcctgggcgacagagcgagactctgtctc

SEQ ID NO: 327578 - DNA, 320 bp, Homo sapiens
gtaagggtagatgcatatgtgcacacagagcagctaacacgatactcagaaaatagtaacaacacaattcccatttagtctaagccaaaaactcttaactatagagagagaacgtgaatggaagggatgaatctttgagaatctgatgaaagcaatcaattctctcctccaaaaaagaatgcacatacacagaaactttacatataattttaggagggtctagaaaccctgaagcccatccagatatacactgtcccaaccagaaatccacgaaccctaagttaagaaatttttccgttttttttttttttttttttttt

SEQ ID NO: 327579 - DNA, 561 bp, Homo sapiens
tgagcagcaacagggccggggctgggcttatcagcctcccagcccagaccctggctgcagacataaataggccctgcaagagctggctgcttagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggagtacactaagaagctcaacacccagtgaggcgcccgccgccgccccccttcccggtgctcagaataaacgtttccaaagtggga

SEQ ID NO: 327580 - DNA, 1036 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327581 - DNA, 1067 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggttcaggccttgccccaggccgggcctctgggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327582 - DNA, 1289 bp, Homo sapiens
  misc_feature (1170)..(1170): n is a, c, g, or t
  misc_feature (1177)..(1177): n is a, c, g, or t
  misc_feature (1180)..(1180): n is a, c, g, or t
  misc_feature (1185)..(1185): n is a, c, g, or t
  misc_feature (1187)..(1187): n is a, c, g, or t
  misc_feature (1197)..(1197): n is a, c, g, or t
  misc_feature (1202)..(1202): n is a, c, g, or t
  misc_feature (1208)..(1208): n is a, c, g, or t
  misc_feature (1214)..(1214): n is a, c, g, or t
  misc_feature (1233)..(1233): n is a, c, g, or t
  misc_feature (1236)..(1237): n is a, c, g, or t
  misc_feature (1241)..(1241): n is a, c, g, or t
  misc_feature (1246)..(1246): n is a, c, g, or t
  misc_feature (1252)..(1252): n is a, c, g, or t
  misc_feature (1260)..(1261): n is a, c, g, or t
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggcccanattgccntanggggngncgattacaantcatnggccgnggtttnacaaggtgggactgggccntgnnggtnccaanttaatngccttggnngaatatccccctttggccgttggcgtcg

SEQ ID NO: 327583 - DNA, 1010 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccagcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327584 - DNA, 789 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgccctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327585 - DNA, 789 bp, Homo sapiens
gaattcaaaaaaaaaagaaaaaaaaaaaaaaaaaaaaaaaaaaaaaagagagactgcgagaaggaggtcccccacggcccttcaggatgaaagctgcggtgctgaccttggccgtgctcttcctgacggcctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327586 - DNA, 1000 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327587 - DNA, 892 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcaccttcagcaagctgcgcgaacagctcggccctgtgacccaggagttctgggataacgtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327588 - DNA, 735 bp, Homo sapiens
gaattcaaaaaaaaaagaaaaaaaaaaaaaaaaaaaaaaaaaaaaaagagagactgcgagaaggaggtcccccacggcccttcaggatgaaagctgcggtgctgaccttggccgtgctcttcctgacggcctaaagctccttgacaactgggacagcgtgacctccaccttcagcaagctgcgcgaacagctcggccctgtgacccaggagttctgggataacgtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327589 - DNA, 673 bp, Homo sapiens
  misc_feature (617)..(617): n is a, c, g, or t
  misc_feature (626)..(626): n is a, c, g, or t
  misc_feature (634)..(634): n is a, c, g, or t
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggagtacactaagaagctcaacacccagtgaggcgcccgccgccgccccccttcccggtgctcagaataaacgtttccaaagtgggacacaccacanacacacaancaaacaancacacaaccccccgcgacacacgcgggccgggaaaaagg

SEQ ID NO: 327590 - DNA, 1012 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaaataaaagaaaatatgccatatgaagcaatgattataacacatgacttaagtattccataatttgaggaaatatataattcaaataatcaaaagattgctaaacatgaactcgaggggggccccgttccaatttcgccttaggagggttgatatgagtggccgcgtgttaaacgggggactgtgaaaccctgggtaccgtcgcctgggcgtgggg

SEQ ID NO: 327591 - DNA, 164 bp, Homo sapiens
ttgtggcccacatgccaccggagaagcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327592 - DNA, 743 bp, Homo sapiens
tgagcagcaacagggccggggctgggcttatcagcctcccagcccagaccctggctgcagacataaataggccctgcaagagctggctgcttagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgccctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327593 - DNA, 990 bp, Homo sapiens
tgagcagcaacagggccggggctgggcttatcagcctcccagcccagaccctggctgcagacataaataggccctgcaagagctggctgcttagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327594 - DNA, 1187 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggttcaggccttgccccaggccgggcctctgggtacctgaggtcttctcccgctctgtgcccttctcctcacctggctgcaatgagtgggggagcacggggcttctgcatgctgaaggcaccccactcagccaggcccttcttctcctccaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327595 - DNA, 982 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacgtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327596 - DNA, 946 bp, Homo sapiens
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327597 - DNA, 751 bp, Homo sapiens
tgagcagcaacagggccggggctgggcttatcagcctcccagcccagaccctggctgcagacataaataggccctgcaagagctggctgcttagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327598 - DNA, 1102 bp, Homo sapiens
  misc_feature (1046)..(1046): n is a, c, g, or t
  misc_feature (1055)..(1055): n is a, c, g, or t
  misc_feature (1063)..(1063): n is a, c, g, or t
tgagcagcaacagggccggggctgggcttatcagcctcccagcccagaccctggctgcagacataaataggccctgcaagagctggctgcttagagactgcgagaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggacacaccacanacacacaancaaacaancacacaaccccccgcgacacacgcgggccgggaaaaagg

SEQ ID NO: 327599 - DNA, 1199 bp, Homo sapiens
  misc_feature (1080)..(1080): n is a, c, g, or t
  misc_feature (1087)..(1087): n is a, c, g, or t
  misc_feature (1090)..(1090): n is a, c, g, or t
  misc_feature (1095)..(1095): n is a, c, g, or t
  misc_feature (1097)..(1097): n is a, c, g, or t
  misc_feature (1107)..(1107): n is a, c, g, or t
  misc_feature (1112)..(1112): n is a, c, g, or t
  misc_feature (1118)..(1118): n is a, c, g, or t
  misc_feature (1124)..(1124): n is a, c, g, or t
  misc_feature (1143)..(1143): n is a, c, g, or t
  misc_feature (1146)..(1147): n is a, c, g, or t
  misc_feature (1151)..(1151): n is a, c, g, or t
  misc_feature (1156)..(1156): n is a, c, g, or t
  misc_feature (1162)..(1162): n is a, c, g, or t
  misc_feature (1170)..(1171): n is a, c, g, or t
gaattcaaaaaaaaaagaaaaaaaaaaaaaaaaaaaaaaaaaaaaaagagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtgggaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggcccanattgccntanggggngncgattacaantcatnggccgnggtttnacaaggtgggactgggccntgnnggtnccaanttaatngccttggnngaatatccccctttggccgttggcgtcg

SEQ ID NO: 327600 - DNA, 946 bp, Homo sapiens
gaattcaaaaaaaaaagaaaaaaaaaaaaaaaaaaaaaaaaaaaaaagagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggga

SEQ ID NO: 327601 - DNA, 3024 bp, Homo sapiens
tgtgagtgtgtatacaagagaggagattactgggaagggtgacgtggtgaggcgggcttgccagtgcagggtgaccctgagggtgtgcccagtggcgtgggtgtgtctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcca

SEQ ID NO: 327602 - DNA, 2799 bp, Homo sapiens
gctaaaacagaggcctgcctgttctggctgggatgagggcagggaggtcgaggtggctgaggtctgggggtggtgagtcagggtgggggctcgtgtaattcttctggggtgcctctgagtcatgggaggctttgcaggcctgtgcttccccagacacccaccctcgtgaggcctgggctggtcagcaagggcccccaggtccctgtagcccatgttagtacttgcctgggctgatgccgaagagagggaggggtgaggatgccactggtgagctgggacctcttaaggctacgtccctgggggaagcctcacacctccaaccctactagactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327603 - DNA, 3197 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccgtgagtgcgggagtgggtatggggttggggaggggggcagcggcgcagactccgggagcccccgccgcagcggggctgtgcgccctaccccagctaggccccttccccgcagaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327604 - DNA, 2282 bp, Homo sapiens
aactggacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327605 - DNA, 2870 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctcctgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327606 - DNA, 1896 bp, Homo sapiens
tgctctaaggatcccggtgggttctgcagaggatgtgtcgtgtcctgcgggacgcggacccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327607 - DNA, 2994 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccagaataaaaaaaaaaagtcgtatcga

SEQ ID NO: 327608 - DNA, 2915 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcca

SEQ ID NO: 327609 - DNA, 1793 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggtgaggcctcacccccagtcgcccgggacccccccaccccactaagccctgaccccgtc

SEQ ID NO: 327610 - DNA, 2109 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatggttcgtagcccagggacttctgctacaacccacttcaaagcctcaagggtttgagaacttggcctggggtcttcttggtgaatgtggtttcttcctttagttatgggtgggaaaacgtttccatcataagacaaggcttgtttcccgcctctgacttcctagggcaaggctgatctcctctctaattctcagggcagggttctgtccccatccccctccatgttcccagaggctgggcatggagggctgcctatcaagcccccatatctatatccctgctgtgcctccctttcccccacccccagtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgagactcgccgctgtcacccgcatgctattttcttccaagaggcaccaagcttacctcatgccgtggtcccca

SEQ ID NO: 327611 - DNA, 1579 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatggtgagaggctggtggggttggtgggtagaggtcgtcaccctcccacagggcaggtgccaagcaaggcccataaagtaagtgagcagtgggtgtggccaggtcttaccaaataccctccttaatcaggcactggcgtcacagagacagacaagacaggtatgaccgtgacctctttgagttcacagatcacatacatgataagatcaagtccaatggccttgaggccagagagagacaagggaggaagggaaaaggagactgggtggctggagggggttgggtaaaggaagccgctgtgctgaggggagtatgagctaattcccaagcacaagacagctagccagcaaaatttagggatgagcattccaggcagagggagcattccaggcagagggagcaactagtgcaaaggcctggatgcaagaacaagcaaaggaatagacttgcagagctagcaatgaaaagggggcctggactgtcaggggccagagtcatttattctaagagtcatgggggctgggcacaatggcttgcacctgtaatcccagcactttgggaggctgaggcgggtggatcacttgagcccagcagttcaagatcagtttgggcaacatgatgagaccctatgtc

SEQ ID NO: 327612 - DNA, 567 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcggggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327613 - DNA, 2969 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcca

SEQ ID NO: 327614 - DNA, 3390 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatggttcgtagcccagggacttctgctacaacccacttcaaagcctcaagggtttgagaacttggcctggggtcttcttggtgaatgtggtttcttcctttagttatgggtgggaaaacgtttccatcataagacaaggcttgtttcccgcctctgacttcctagggcaaggctgatctcctctctaattctcagggcagggttctgtccccatccccctccatgttcccagaggctgggcatggagggctgcctatcaagcccccatatctatatccctgctgtgcctccctttcccccacccccagtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327615 - DNA, 2331 bp, Homo sapiens
tgaactgcattttgcaagtcgacatactagaggctccccaactcagggcgagctgcaggcctcggtcatcaccctactacaccatgtttgtcacctggtcagccctatccagtataccctgaacagaaatgcaacccccatttgccaacccagctgggcaacgagacagttgtggcaggccccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327616 - DNA, 2394 bp, Homo sapiens
aactggacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccgtgagtgcgggagtgggtatggggttggggaggggggcagcggcgcagactccgggagcccccgccgcagcggggctgtgcgccctaccccagctaggccccttccccgcagaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327617 - DNA, 1700 bp, Homo sapiens
gttaccattctgatgttggagcggccgcatatctatatcccgtgctgtgcctcccgtttcccccacttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327618 - DNA, 1900 bp, Homo sapiens
tgctgatggaagctctccctgttcagtcccatctccacatcctttcctgggctgtgtctccaccctgtggatgctgcccaacccacactcttccagtccacactcttcacaacccaaacatgctgagggtagacgcctcaaaggcgaggagacactagccccagctgtccgggagcaccaatggtcattaccccttctcatccctgcagacgttggcacggtgctgaaggtgatctcggtccccaagggcagtaggcccagcgcagaggggctgctcctggaggagctgcacgtgtttgaggactcggccgctgtcaccagcatgcaaatttcttccaagagggtgagtgaccaggatgggggtcggggtgggatggactgagcttgtgcctggcgcgtcccaagcctctggccccttttggtagtttgcagtcccgggtttgagtacaggctctggctttgttagactgtgtgacctgaggcgtaagacctcagtgttcccatctgtcgagtggaagaagggatccctgaccgatgggaggcaggcgtggggtcgccctcggtcagcccagagcccctcgtgccccctagcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcaggcggaacaaaaagaaaacagacaaacgccccaccgcaccaaagacaaaacacgaagcccaaccaacgacacaaaagggggggcacaaagaccccg

SEQ ID NO: 327619 - DNA, 1623 bp, Homo sapiens
  misc_feature (1567)..(1567): n is a, c, g, or t
  misc_feature (1603)..(1603): n is a, c, g, or t
  misc_feature (1617)..(1617): n is a, c, g, or t
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggggggcggcccctcctttttccctaacaaaanttttgggaggcccaaaattttacaaccctttcaacntccaaaaattttgncccgcc

SEQ ID NO: 327620 - DNA, 1116 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccgggtgaggagtccctgggccaca

SEQ ID NO: 327621 - DNA, 2038 bp, Homo sapiens
acggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatggtgagaggctggtggggttggtgggtagaggtcgtcaccctcccacagggcaggtgccaagcaaggcccataaagtaagtgagcagtgggtgtggccaggtcttaccaaataccctccttaatcaggcactggcgtcacagagacagacaagacaggtatgaccgtgacctctttgagttcacagatcacatacatgataagatcaagtccaatggccttgaggccagagagagacaagggaggaagggaaaaggagactgggtggctggagggggttgggtaaaggaagccgctgtgctgaggggagtatgagctaattcccaagcacaagacagctagccagcaaaatttagggatgagcattccaggcagagggagcattccaggcagagggagcaactagtgcaaaggcctggatgcaagaacaagcaaaggaatagacttgcagagctagcaatgaaaagggggcctggactgtcaggggccagagtcatttattctaagagtcatgggggctgggcacaatggcttgcacctgtaatcccagcactttgggaggctgaggcagacagattgcttgaagacaggagtttcataccagcctgggctacaaagcaagacaaaaaataaaataaaattagctgggggcagtggcatgcacacacctgtagtcctggctagtcaggaggctgagatggaaggatcacttgagcccaggagttggaggctgcagtgagccatgatgctgccactgcaggacagagcagaccctgtctctaaatcaaataaaaattaaataagggctatgggctggtgggcacagtggctcacacctgtaatctcagcactttgggaggcggaggcaggcaaatcgcttgaggccaggagtttgagactagcctggccaacatggtgaaaccctgtctctactaaaaaatacaaaaattggccgggtgcagtggtgtgcacctgtaatcccagcactttgggaggctgaggcgggcggatcacctgagttcaggcatttgagaccagcctggccaacatggtgtaaccccgtctctactaaatatacaaaaattagtccg

SEQ ID NO: 327622 - DNA, 3973 bp, Homo sapiens
cagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaagggagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgca

SEQ ID NO: 327623 - DNA, 8007 bp, Homo sapiens
  misc_feature (4820)..(4820): n is a, c, g, or t
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327624 - DNA, 6247 bp, Homo sapiens
  misc_feature (4820)..(4820): n is a, c, g, or t
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgca

SEQ ID NO: 327625 - DNA, 7619 bp, Homo sapiens
  misc_feature (4432)..(4432): n is a, c, g, or t
atccgagcggcctcctccacccggcgtcctcctttgccttcgcccagcctgcgggacggccagacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327626 - DNA, 7588 bp, Homo sapiens
  misc_feature (4401)..(4401): n is a, c, g, or t
tgccgctagaggccttgggtactgtttggcctaaggatgggcgttgtgcctccagacaggggcagggacctctagtcagcaccacgcgccctccgtgtccttgatacgaaatacatacacatatagtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327627 - DNA, 7896 bp, Homo sapiens
  misc_feature (4709)..(4709): n is a, c, g, or t
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327628 - DNA, 7840 bp, Homo sapiens
  misc_feature (4653)..(4653): n is a, c, g, or t
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327629 - DNA, 6737 bp, Homo sapiens
  misc_feature (3550)..(3550): n is a, c, g, or t
tgaagtcctggttggagggaggccggtggggtggggtggggaccatgggtgctggagaggcgtgcattgctcagtggttaagcgcaccctctggagacggaaaacctgggttcgcgtctcatttctgcactgtagtagctgagccgcctggggtaagtgcctttcctttcggaggcgggtcggtaccttgagggaggtggtggcggctgtcctgccagtgtctggcggggttggtgacgccctgccctgctgtattctcaggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327630 - DNA, 6691 bp, Homo sapiens
  misc_feature (3504)..(3504): n is a, c, g, or t
cagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327631 - DNA, 5856 bp, Homo sapiens
  misc_feature (4820)..(4820): n is a, c, g, or t
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtccggtatttaccctatagccccccctctaccccctttagagcca

SEQ ID NO: 327632 - DNA, 5411 bp, Homo sapiens
  misc_feature (4820)..(4820): n is a, c, g, or t
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcgaaaaataaaaacgtagaaaaatctctg

SEQ ID NO: 327633 - DNA, 5763 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaaccttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327634 - DNA, 5023 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327635 - DNA, 4385 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggcttcctcagaaccctgaggtctctgctttctcagcttgtcgctgtgctccccgggatacag

SEQ ID NO: 327636 - DNA, 4412 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgagggttgggggcatggtctgcaggctcatctgtgtccgcctttcactccactaatgctgtctcagtgttttcctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcccctcctctcccctccttttccttccttccttcctttccttggagcactgagcaccatttggaagcttgagagaaaccaaaattaaagagagaaagagagagcgtgca

SEQ ID NO: 327637 - DNA, 3547 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327638 - DNA, 1045 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctggtctccatgggatcctctagatcactcaga

SEQ ID NO: 327639 - DNA, 949 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatggtgagtgcccagccagtgggccctcctctcccctccttttccttccttccttcctttccttggagcactgagcaccatttggaagcttgagagaaaccaaaattaaagagagaaagagagagcgtgca

SEQ ID NO: 327640 - DNA, 682 bp, Homo sapiens
accccgtctttactaaaaacacaaaaattagccgggcatagtggcgcgcgcctgtaatcccagctactccggaggctgaggcagaattgtttgaacccaggaggcggaggttgcagtgagcagagatcacgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgttggtaaggggagcggcgggcgagcaggcgggcggggatagcatctccttttggtcttgcgccccgcgagccccgaggccttctcggccgtcgcagcagcagacgccgcgcgcgagcgtcgacagggt

SEQ ID NO: 327641 - DNA, 8944 bp, Homo sapiens
  misc_feature (5757)..(5757): n is a, c, g, or t
cagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaagggagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327642 - DNA, 7573 bp, Homo sapiens
  misc_feature (4386)..(4386): n is a, c, g, or t
tggtagtaacagttagatatgggatccaggggctggaatttgcctcccaacttgcccacctgtgtacagtggggagaacaggtgtgacttgatgtcctctctctctgcaggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327643 - DNA, 7785 bp, Homo sapiens
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327644 - DNA, 7559 bp, Homo sapiens
  misc_feature (4372)..(4372): n is a, c, g, or t
catggtccccggatcctgatgtcactctcctcgctgaagccctggtgactgtcacaaacatcgaggttattaattgcagcatcacagaaatagaaacaacgacttccagcatccctggggcctcagacacaggtctcatccccatggaaggggtgaaggcctcgtccacctccgatccaccagctctgcctgactccactaacacaaaaccacacatcactgaggtcacagcctctgccgagaccctgtccacagccggcaccacagagtcagctgcacctcatgccacggttgggaccccactccccacagagagagcgtgacgctctctctgtggggctatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327645 - DNA, 7538 bp, Homo sapiens
  misc_feature (4820)..(4820): n is a, c, g, or t
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtctttcctgtgtgggctgtttgcatccattgtctcctccagaggtctgggggtgtcactccagggggatctcagccaggggctggaaaggcccccctgtcctccctatacggcacagccagagtgtctgcaggggctggcaccccacttcctggctgagggtgaactccagcttggggaggtggacctgggaaccatggggcaccttggccacggtgaggtgggggtgcagctgccctggagactgtagtgtactcagcccctcggcttccagcctctggctcagcacttgtgccatgctttccagtgtgggagagggtggggcacacagcacatgcgggcccaggaggaccagctttctaaagctcagccgagggggtgcatttagccccggggccaagagggcccgtctcagagctccaatggcagcggcctcctccccagcgcctgccagtcgcagcagggccagggtcaggtgtaggttctgagagggcactaggaagttggcgcagtgtggggccacgtggaccaggtattcctgggccttggtcacttctgcttgtagcccaggctcggtcaccatgagggccacaaaatgtgtggggcgcggttggcaaggggctgcaacactaaggcgggcccttttgtcctcgggccaggccgcaggaccccactcggcttctgtcgtctcagcggagccccccgggactcccagggcctgtgcttccttgccccccagcaatgtggtcctggtggctgctgttggcttcagtgcctcctcagtcactccggcgaggcgtcctcttggggccagtgttcccaaatcagcagctgtgcccagcgccctctcctgggccgcctccagctctccgggttcctccacgcctggttcctggtgccctgtgcagagcggccttgtgctccctcgcttgggggcagcctgggcctcctgacctgtccccgccagtgtccactcggcaccctctgccccgtgggcgccctcggtgttcggtgcgtccaggatggtgggcccgcgtcccgccgccgagccagagccaaagacgaggtcggtgcgcgaggcgcggtcccacacaaggcggccacggaagcggaagaagcgcacgcggtgctggggcactgccagcacgcccggcccgagcgccgccagcggctggtcccagcaaaaggcgctgaagggctcctcgcgcacacccagaaagcggtcgacgtagcccaccgagaagtcggcggggtcgaggcgcgggtcccagcggatgcgctggatgacgtccgcggctgtgcgcagcggcggcttcttggccccggcctccggctgcgcctcgcggccaggcggcgccggcgccccagggtggggctggcggcagcgggcgccgaagcggcagcggccttccaggaagaagcggcaggccggcgggggcgcgggttccgtggcgggggcttcctgcggcaactccggctctctggccgctgccatgggtgcggggaactggcacgcccgccgcgcagacgaggtcgccccgcacggagggcggctccccatggatgcaccgagcctcacccgacagtggcgtcagcggcccgcgctccggcctagctctggggaccacgccgcgtgccctcgcgaggactctggcccagtccctccttggtggagagcctgacaccgctgctctgggacttccgccggcgccctcccccagcgccaggaaagcaagctgcgtaaaggc

SEQ ID NO: 327646 - DNA, 6025 bp, Homo sapiens
  misc_feature (4820)..(4820): n is a, c, g, or t
ttttttgagatggagtctttctctgttgcccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctgtgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgngccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccccctcctctcccctccttttccttccttccttcctttccttggagcactgagcaccatttggaagcttgagagaaaccaaaattaaagagagaaagagagagcgtgca
